US008569064B2

(12) United States Patent
Spangenberg et al.

(10) Patent No.: US 8,569,064 B2
(45) Date of Patent: Oct. 29, 2013

(54) MANIPULATION OF FLAVONOID BIOSYNTHESIS IN PLANTS

(75) Inventors: German Spangenberg, Bundoora (AU); Timothy Ivor Sawbridge, Collingwood (AU); Eng-Kok Ong, Vermont South (AU); Michael Emmerling, Greensborough (AU)

(73) Assignees: Agriculture Victoria Services Pty Ltd., Attwood (AU); AgResearch Limited, Hamilton (NZ)

( * ) Notice: Subject to any disclaimer, the term of this patent is extended or adjusted under 35 U.S.C. 154(b) by 40 days.

(21) Appl. No.: 12/844,615

(22) Filed: Jul. 27, 2010

(65) Prior Publication Data

US 2011/0055974 A1  Mar. 3, 2011

Related U.S. Application Data

(62) Division of application No. 10/491,823, filed as application No. PCT/AU02/01345 on Oct. 4, 2002, now Pat. No. 7,767,416.

(30) Foreign Application Priority Data

Oct. 5, 2001 (AU) .................................. PR 8113

(51) Int. Cl.
*C12N 5/04* (2006.01)
*C07H 21/04* (2006.01)
*C12N 15/00* (2006.01)

(52) U.S. Cl.
USPC ...................... 435/419; 536/23.1; 435/320.1

(58) Field of Classification Search
None
See application file for complete search history.

(56) References Cited

U.S. PATENT DOCUMENTS

| 6,054,636 A | 4/2000 | Fader |
| 7,115,396 B2 | 10/2006 | Lipovsek et al. |
| 2004/0191787 A1* | 9/2004 | Tanner et al. ............ 435/6 |

FOREIGN PATENT DOCUMENTS

| EP | 0316797 A2 | 5/1989 |
| EP | 1033405 A2 | 9/2000 |
| WO | 95/27790 | 10/1995 |
| WO | 96/36716 | 11/1996 |
| WO | 97/12982 | 4/1997 |
| WO | 98/07836 | 2/1998 |
| WO | 99/14351 | 3/1999 |
| WO | 99/36543 | 7/1999 |
| WO | 00/43983 | 7/2000 |
| WO | 00/44909 | 8/2000 |
| WO | 01/05984 A2 | 1/2001 |
| WO | 02/18604 A2 | 3/2002 |
| WO | 02/26994 A1 | 4/2002 |
| WO | 02/10210 A2 | 7/2002 |
| WO | 02/063021 A2 | 8/2002 |
| WO | 03/031622 A1 | 4/2003 |

OTHER PUBLICATIONS

Davic et al., The Plant Journal, (1999) 19(4), 387-398.*
NCBI Database—GenBank AF184270; Hirner, A.A. et al. *Daucus carota* flavanone 3-hydroxylase (F3H) mRNA, complete CDS, PLN Jul. 20, 2001.
NCBI Database—GenBank BAA36553; Moriguchi, T. et al. flavanone 3-hydroxylase [*Citrus sinensis*]; PLN Nov. 8, 2000.
NCBI Database—GenBank AAC49176; Pelletier, M.K. et al. flavanone 3-hydroxylase [*Arabidopsis thaliana*]; PLN Feb. 29, 1996.
NCBI Database—GenBank AAC49929; Van Houwelingen, A. et al. flavanone 3beta-hydroxylase [*Petunia x hybrida*]; PLN Feb. 25, 1998.
McKann, H et al. "Isolation of Chalcone Synthase and Chalcone Isomerase cDNAs from Alfalfa (*Medicago sativa* L): Highest Transcript Levels Occur in Young Roots and Root Tips" 1994, pp. 767-777, vol. 24, No. 5, Plant Molecular Biology.
Database NCBI (Online), AAA17993, May 10, 1994, Howles, P.A., Arioli, T. and Weinmann, J.J., "Characterization of a phenylalanine ammonia-lyse multigene family in *Trifolium subbterraneum*", Gene 138 (1-2), 87-91 (1994).
Database Uniprot (Online), Swisprot P51088, Oct. 1, 1996, Howles, P.A., Arioli, T. and Weinmann, J.J., "Nucleotide sequence of additional members of the gene family encoding chalcone synthase in *Trifolium subterraneum*", Plant Physiol, 107: 1035-1036 (1995).
Database NCBI (Online), CAA63306, Nov. 16, 2006, Haussuehl, K.K., Rohde, W. and Weissenboeck, G., "Expression of chalcone synthase genese in coleoptiles and primary leaves of *Secale cereale* L after induction by UV radiation: evidence for a UV-porective role of coleoptile", Bot. Acta 109, 229-238 (1996).
Protein Information Resource Database (Online), S66262, Oct. 28, 1996, Guo, L/ and Paiva, N.L., "Molecular cloning and expression of alfalfa (*Med* L.) vestitone reductase, the penultimate enzyme medicarpin biosynthesis", Arch. Biochem. Biophys. (1995) 320: 353-360.
Database Uniport (Online), Swisport P51109, Oct. 1, 1996, Charrier B., Coronado, C., Kondorosi, A. and Rater, P., "Molecular characterization and expression of alfalfa (*Medicago sativa* L.) flavanone-3—hydroxylase and dihydroflavonol-4-reductase encoding genes", Plant Mol. Biol. 29 : 773-786 (1995).
Protein Information Resource Database (Online), S44371, Jan. 13, 1995, McKhann, H.I. and Hirsch, Am., "Isolation of chalcone synthase and chalcone isom from alfalfa (*Medicago sativa* L.): highest trans occur in young roots and root tips", Plant Mol. Biol. (1994) 24: 767-777.
Database NCBI (Online), Medline abstract 11164576, Dec. 7, 2000, Aida, R., Yoshida, K., Kondo, T., Kishimoto, S., and Shibata, M., "Copigmentation gives bluer flowers on transgenic torenia plants with the antisense dihydroflavonol-4-reductase gene", Mational Research Insistute of Vegetable, Ornamental Plants and Tea, Ano, 514-2392, Mie, Japan, 160 (1): 49-56.

(Continued)

*Primary Examiner* — Nancy T Vogel
(74) *Attorney, Agent, or Firm* — Larson & Anderson, LLC

(57) ABSTRACT

The present invention relates to nucleic acids and nucleic acid fragments encoding amino acid sequences for flavonoid biosynthetic enzymes in plants, and the use thereof for the modification of flavonoid biosynthesis in plants. More particularly, the flavonoid biosynthetic enzyme is selected from the group consisting of chalcone isomerase (CHI), chalcone synthase (CHS), chalcone reductase (CHR), dihydroflavonol 4-reductase (DFR), leucoanthocyanidin reductase (LCR), flavonoid 3',5' hydrolase (F3'5'H), flavanone 3-hydroxylase (F3H), flavonoid 3'-hydroxylase (F3'H), phenylalanine ammonia-olyase (PAL) and vestitone reductase (VR), and functionally active fragments and variants thereof.

8 Claims, 271 Drawing Sheets

(56) References Cited

OTHER PUBLICATIONS

Database NCBI (Online), Medline abstract 7891963, Sep. 1994, Yamada, T., Sriprasertsak, P., Kao, H., Hashimoto, T., Shimuzu, H., Shiraishi, T., "Functional analyis of the promoters of phenylalanine ammonia-lyases genes in pea", Laboratory of Plant Pathology & Genetic Engineering, College of Agriculture, Okayama Univeristy, Japan., 35 (6): 917-926.
New Zealand Examination Report dated Jul. 13, 2007 for corresponding New Zealand Patent Application No. 543387.
Blyden, et al., 1991; Plant Mol. Biol; vol. 16 (1); pp. 167-169; (Genbank X16470).
NCBI Database—GenBank X16470; Blyden, et al.; *Phaseolus vulgari* gene for chalcone ismerase; PLN Apr. 18, 2005.
Supplementary European Search Report for corresponding European Patent Application No. 02800506, dated Jan. 2, 2007.
Database EMBL (Online), Jul. 31, 2001, "EST5311934 GESD Medicago truncatula cDNA clone pGESD7I14 5' end, mRNA sequence." XP002413000 retrieved from EBI accession No. EM_EST: BI310184, Database accession No. BI310184.
Devic Martine, et al. "The BANYULS gene encodes a DFR-like protein and is a marker of early seed coat development", Plant Journal, vol. 19, No. 4, Aug. 1999, pp. 387-398, XP002982937, ISSN 0960-7412.
Database NCBI, Jan. 11, 2000, AF092912, related to Devic et al., ibid.
European Search Report for corresponding European Patent Application No. 02800506.4-2401, PCT/AU0201345, dated Nov. 10, 2006.
Genbank Acc No. AAB41524 chalcone Isomerase (*Medicago sativa*) Jan. 29, 1997.
Genbank Acc No. CAA74847 anther-specific protein (*Nicotiana sylvestris*), Feb. 24, 1999.
Genbank Acc No. CAC14061 putative chalocone synthase (*Ruta graeolens*) Oct. 27, 2000.
Genbank Acc No. AAB41556 chalocone reductase (*Medicago sativa*) Jan. 30, 1997.
Genbank Acc No. CAA11226 chalone reductase (*Sesbania rostrata*) Jul. 3, 2001.
Genbank Acc No. AAK52955 dihydro-flavonoid reductase-like protein (*Zea mays*) May 14, 2001.
Genbank Acc No. AAD54273 dihydroflavonol-4-reductase DFR1 (*Glycine max*) Sep. 10, 1999.
Genbank Acc No. CAA80265 flavonoid 3', 5'-hydroxylase (*Petunia x hybrida*) Dec. 7, 1993.
Genbank Acc No. AAF23859 DFR-like protein (*Arabidopsis thaliana*) Jan. 11, 2000.
Genbank Acc No. BAB01697 oxidase-like protein (*Arabidopsis thaliana*) Dec. 27, 2000.
Trembl Acc No. CAB63776 F3'H1 protein (*Glycine max*) May 1, 2000.
Genbank Acc No. CAB78172 putative flavanone 3-beta-hydroxylase (*Arabidopsis thaliana*) Mar. 16, 2000.
Genbank Acc No. AAG49298 putative flavonoid 3'-hydroxylase (*Callistephus chinensis*) Jan. 16, 2001.
Genbank Acc No. AAA99500 Phenylalanine ammonia lyase (*Stylosanthes humilis*) May 15, 1996.
Genbank Acc No. CAA41169 phenylalanine ammonia lyase (*Medicago sativa*) May 5, 1995.
Genbank Acc No. AAB41550 vestitone reductase (*Medicago sativa*) Jan. 30, 1997.
Arioli, T. et al. "In *Trifolium subterraneum*, chalcone synthase is encoded by a multigene family" Gene, vol. 138: 79-86, 1994.
Supplementary Partial European Search Report for corresponding European Patent Application No. EP 0280 0506, May 24, 2006.
Database Uniprot (Online), Mar. 1, 2001, Kanekao et al., XP002402226, retrieved from EBI Databse accession No. Q9FGH3, abstract.
Adrian, D et al. "Expression of an Antirrhinum Dihydroflavono Reductase Gene Results in Changes in Condensed Tannin Structure and Accumulation in Root Cultures of *Lotus corniculatus* (Bird's Foot Trefoil)", Plant Molecular Biology, vol. 35, No. 4, 1997, pp. 443-458, XP002402078, ISSN: 0167-4412.
Carron, T. R. et al. "Genetic Modification of Condensed Tannin Biosynthesis in *Lotus coniculatus*. 1 Heterologous Antisense Dihydroflavonol Reuctase Down-Regulates Tannin Accumulation in Hair Root Cultures" Theoretical and Appl;ied Genetics, Springer, Berlin, DE, vol. 87, No. 8, Mar. 1, 1994, pp. 1006-1015, XP002006034, ISSN: 0040-5752.
Roslyn, J et al. "Proanthocyanidin Anidin Synthesis in the Forage Legume *Onobrychis viciifoloia*. As Study of the Chalcone Synthases, Dihydroflavonol 4- Reductase in Developing Leaves", Australian Journal of Plant Physiology, vol. 25, No. 3, 1998, pp. 271-278, XP009073207, ISSN 0310-7841.
Arioli, Tony et al. "In *Trifolium subterraneum*, Chalcone Synthase is Encoded by a Multigene Family", Plant Microbe Interaction Group, Research School of Biological Sciences, Australian National University, Canberra City, ACT. 2601, Australia, Gene 138 (1994), pp. 79-86, XP008059793, SSDI 0378-1119.

\* cited by examiner

```
                *         20         *         40         *         60
TrCHIa : GCATTAAACANTGAAANTTGACCAGTCCCAACAAAGATCTGAAACACATAGCTCCCCATT : 60

*         80         *        100         *        120
TrCHIa : TTTTAACATTAAACTAAAAATATGTCGGCCATCACCGCAATCCAAGTCGAGAACCTTGAA : 120

*        140         *        160         *        180
TrCHIa : TTTCCGGCTGTGATTACTTCTCCGGCCACCGGTAAGTCATATTTTCTTGGTGGTGCAGGG : 180

*        200         *        220         *        240
TrCHIa : GAGAGAGGTTTGACTATTGAAGGAAACTTCATCAAGTTCACTGCCATAGGAGTATATTTG : 240

*        260         *        280         *        300
TrCHIa : GAAGATGTAGCAGTGGCTTCACTTGCCACTAAATGGAAGGGCAAATCCTCTGAAGAGTTG : 300

*        320         *        340         *        360
TrCHIa : CTTGAGACCCTTGACTTCTACAGAGATATCATTTCAGGACCATTTGAGAAGTTGATTCGA : 360

*        380         *        400         *        420
TrCHIa : GGATCGAAGATTAGGGAATTGAGTGGTCCTGAGTACTCAAGGAAGGTTAATGAAAACTGT : 420

*        440         *        460         *        480
TrCHIa : GTGGCACACTTAAAATCTGTTGGGACTTATGGAGATGCAGAAGTTGAAGCTATGCAAAAA : 480

*        500         *        520         *        540
TrCHIa : TTTGTTGAAGCCTTCAAGCCTATTAATTTTCCACCTGGTGCCTCTGTTTTTTACAGGCAA : 540

*        560         *        580         *        600
TrCHIa : TCACCTGATGGAATATTAGGGCTTAGTTTCTCTCAAGATGCAAGTATACCAGAAAAGGAA : 600

*        620         *
TrCHIa : GCTGCAGTAATAGAGAACAAGGGAGCTTCATCGGCG : 636
```

FIGURE 1

```
                    *         20         *         40         *         60
TrCHIa : MSAITAIQVENLEFPAVITSPATGKSYFLGGAGERGLTIEGNFIKFTAIGVYLEDVAVAS :  60

*         80         *        100         *        120
TrCHIa : LATKWKGKSSEELLETLDFYRDIISGPFEKLIRGSKIRELSGPEYSRKVNENCVAHLKSV : 120

*        140         *        160         *        180
TrCHIa : GTYGDAEVEAMQKFVEAFKPINFPPGASVFYRQSPDGILGLSFSQDASIPEKEAAVIENK : 180

TrCHIa : GASSA : 185
```

FIGURE 2

```
                        *         20         *         40         *         60
TrCHIa1 : GCATTAAACATTGACA-NAGT-CCNAAT-AAAAAAGATCTGAAACACATAGTNCCCCATT :  57
TrCHIa2 : ---------------GNTTGCCCGGTCCCAACAAAGATCTGAAACACATAGCCCCCATT :  45
TrCHIa3 : ------------------------------GGATCTGAAACACATAG-TNCCC--     :  23
TrCHIa4 : ------------------------------GNGATCTGAAAAACNTAG-TACCCA--   :  24
TrCHIa5 : ---------CNTTAAANTTGACCAGTCCNAACAAAGATCTGAAACACATAGCCCCCATT :  51

*         80         *        100         *        120
TrCHIa1 : TTTTAACATTAAACTAAAAATATGTCGGCCATCACCGCAATCCAAGTCGAGAACCTTGAA : 117
TrCHIa2 : TTTTAACATTAAACTAAAAATATGTCTGCCATCACCGCAATCCAAGTCGAGAACCTTGAA : 105
TrCHIa3 : TTTTAACATTAAACTAAAAATATGTCGGCCATCACCGCAATCCAAGTCGAGAACCTTGAA :  83
TrCHIa4 : TTTTAANATTAAACTAAAAATATGTCGGCNATCACCGCAATCCAAGTCGAGAACCTTGAA :  84
TrCHIa5 : TTTTAACATTAAACTAAAAATATGTCTGCCATCACCGCAATCCAAGTCGAGAACCTTGAC : 111

*        140         *        160         *        180
TrCHIa1 : TTTCCGGCTGTGNTTACTTCTCCGGCCACCGGTAAGTCATATTTTCTTGGTGGTGCAGGG : 177
TrCHIa2 : TTCCCGGCEGTGATTACTTCTCCGGTCAACGGTAAGTCATATTTTCTTGGTGGTGCAGCC : 165
TrCHIa3 : TTTCCNGCTGTGATTACTTCTCCGGCCACCGGTAAGTCATATTTTCTTGGTGGTGCAGGG : 143
TrCHIa4 : TTTCCNGCTGTGATTACTTCTCCGGCCACCGGTAAGTCATATTTTCTTGGTGGTGCAGGG : 144
TrCHIa5 : TTCCCGGCEGTGATTACTTCTCCGGTCAACGGTAAGTCATATTTTCTTGGTGGTGCAGGG : 171

*        200         *        220         *        240
TrCHIa1 : CAGAGACGTTTGACTATTGAAGGAAACTTNNTCAANGGCGCTGNATAGGACCGTNTTNG : 237
TrCHIa2 : GAGAGAGGTTTGACTATTGAAGGAAACTTCATCAAGTTCACTGCCATAGGAGTATATTTG : 225
TrCHIa3 : GAGAGAGGTTTGACTATTGAAGGAAACTTCATCAAGTTCACTGCCATAGGAGTATATTTG : 203
TrCHIa4 : GAGAGACGTTTGACTATTGAAGGAAACTTCATCAAGTTCACTGCCATAGGAGTATATTTG : 204
TrCHIa5 : GAGAGAGGTTTGACTATTGAAGGAAACTTCATCAAGTTCACTGCCATAGGAGTATATTTG : 231

*        260         *        280         *        300
TrCHIa1 : AANAN------------------------------------------------------ : 244
TrCHIa2 : GAAGATGTAGCAGTGGCTTCACTTGCCACTAAATGGAAGGGCAAATCCTCTGAAGAGTTG : 285
TrCHIa3 : GAAGATGTAGCAGTGGCTTCACTTGCCACTAAATGGAAGGGTAAATCCTCTGAGGAGTTG : 263
TrCHIa4 : GAAGATGNANNANGGGNTNCNNTN------------------------------------ : 228
TrCHIa5 : GAAGATGTAGCAGTGGCTTCACTTGCCACTAAATGGAAGGGCAAATCCTCTGAAGAGTTC : 291

*        320         *        340         *        360
TrCHIa1 : ------------------------------------------------------------ :   -
TrCHIa2 : CTTGAGACCCTTGACTTCTACAGAGATATCATTTCAGGACCATTTGAGAAGTTGATTCGA : 345
TrCHIa3 : CTTGAGACTCTTGACTTCTATAGAGACATCATTTCAGGACCTTTGANAAGTTGATTCGA : 323
TrCHIa4 : ------------------------------------------------------------ :   -
TrCHIa5 : CTTCAGACCCTTGACTTCTACAGAGATATCATTTCAGGACCATTTGAGAAGTTGATTCGA : 351

*        380         *        400         *        420
TrCHIa1 : ------------------------------------------------------------ :   -
TrCHIa2 : GGATCGAAGATTAGGGAATTGAGTGGTCCTGAGTACTCAAGGAAGGTTAATGAAAACTGT : 405
TrCHIa3 : GGATCGAAGATTAGGGAATTGAGTGGTCCTGAGTACTCAAGGAAGGTTAATGAAAACTGC : 383
TrCHIa4 : ------------------------------------------------------------ :   -
TrCHIa5 : GGATCCAAGATTAGGGAATTGAGTGGTCCTGAGTACTCAAGGAAGGTTAATGAAAACTGT : 411
```

FIGURE 3

```
              *         440         *         460         *         480
TrCHIa1 : ------------------------------------------------------------ :   -
TrCHIa2 : GTGGCACACTTAAAATCTGTTGGGACTTACGGAGATGCAGAAGTTGAAGCTATGCAAAAA : 465
TrCHIa3 : GTGGCCCACTTAAAATCTGTTGGGACTTATGCAGATGCTGAAGCTGAACCTATGCAAAAA : 443
TrCHIa4 : ------------------------------------------------------------ :   -
TrCHIa5 : GTGGCACACTTAAAATCTGTTGGGACTTATGGAGATGCAGAAGTTGAAGCTATGCAAAAA : 471

*         500         *         520         *         540
TrCHIa1 : ------------------------------------------------------------ :   -
TrCHIa2 : TTTGTTGAAGCCTTCAAGCCTATTAATTTTCCACCTGGTGCCTCTGTTTTTTACAGGCAA : 525
TrCHIa3 : TTTGTTGAAGCCTTCAAGCCTATTAATTTTCCACCTGGTGCCTCTGTTTTTTACAGGCAA : 503
TrCHIa4 : ------------------------------------------------------------ :   -
TrCHIa5 : TTTGTTGAAGCCTTCAAGCCTATTAATTTTCCACCTGGTGCCTCTGTTTTTTACAGGCAA : 531

*         560         *         580         *         600
TrCHIa1 : ------------------------------------------------------------ :   -
TrCHIa2 : TCACCTGATGGAATATTAGGGCTTAGTTTCTCTCAAGATGCAAGTATACCAGAAAAGGAA : 585
TrCHIa3 : TCACCTGATGGAATATTAGCCCTTAGTTTCTCTCAAGATGCAAGTATACCAGAAAAGGAG : 563
TrCHIa4 : ------------------------------------------------------------ :   -
TrCHIa5 : TCACCTGATGGAATATTAGGGCTTAGTTTCTCTCAAGATGCAAGTATACCAGAAAAGN-- : 589

*         620         *
TrCHIa1 : --------------------------------- :   -
TrCHIa2 : GCTGCAGTAATAGAGAACANN------------ : 606
TrCHIa3 : GCTGCAGTAATAGAGAACAAGGGAGCTTCATCGGCG : 599
TrCHIa4 : --------------------------------- :   -
TrCHIa5 : --------------------------------- :   -
```

FIGURE 3 (cont)

```
              *         20         *         40         *         60
TrCHIb : TTAAAATTGACACAGTCCCAACCTTAAANTTGACCNGGTCCCAAACAAAGATCTGAAACA :  60

*         80         *        100         *        120
TrCHIb : ACATAGCCCCCCATTTTTTAACATTAAACTAAAAATATGTCTGCCATCACCGCAATCCAA : 120

*        140         *        160         *        180
TrCHIb : GTCGAGAACCTTGAATTCCCGGCGGTGATTACTTCTCCGGTCAACGGTAAGTCATATTTT : 180

*        200         *        220         *        240
TrCHIb : CTTGGTGGTGCAGGGGAGAGAGGTTNGACTATTGAAGGAAACTTCATCAAGTTCACTGCC : 240

*        260         *        280         *        300
TrCHIb : ATAGGAGTATATTTGGAAGATGTAGCAGGGGCTTCACTTGCCACTAAATGGAAGGGCAGA : 300

*        320         *
TrCHIb : TCCTCTGAAGAGNGCTTGAGACCCTNGACTNC : 332
```

FIGURE 4

```
                 *        20         *        40         *        60
TrCHIb : MSAITAIQVENLEFPAVITSPVNGKSYFLGGAGERGXTIEGNFIKFTAIGVYLEDVAGAS : 60

*
TrCHIb : LATKWKGRSSEEXLRPXT : 78
```

FIGURE 5

```
              *         20         *         40         *         60
TrCHIb1 : TTAAAATTGACCNAGTCCNAACCTTAAANTTGACCNGGTCCCAAACAAAGATCTGAAACA :  60
TrCHIb2 : -TTAANTTGACACAGTCCCAACCTTAAANTTGACCNGGTCCCAAACAAAGATCTGAAACA :  59
TrCHIb3 : --------------------GCGTTAAAATTGACCCAGT-CCNAACAAAGATCTGAAAC- :  38

*         80         *        100         *        120
TrCHIb1 : ACATAGCCCCCCATTTTTTAACATTAAACTAAAAATATGTCTGCCATCACCGCAATCCAA : 120
TrCHIb2 : ACATAGCCCCCCATTTTTTAACATTAAACTAAAAATATGTCTGCCATCACCGCAATCCAA : 119
TrCHIb3 : ACATAGCCCCCCATTTTTTAACATTAAACTAAAAATATGTCTGCCATCACCGCAATCCAA :  98

*        140         *        160         *        180
TrCHIb1 : GTCGAGAACCTTGAATTCCCGGCGGTGATTACTTCTCCGGTCAACGGTAAGTCATATTTT : 180
TrCHIb2 : GTCGAGAACCTTGAATTCCCGGCGGTGATTACTTCTCCGGTCAACGGTAAGTCATATTTT : 179
TrCHIb3 : GTCGAGAACCTTGAGTTCCCGGCCGAGATTACTTCTNCGGCGAANGGAAGGGATATTNT  : 158

*        200         *        220         *        240
TrCHIb1 : CTTGGTGGTGCAGGGGAGAGAGGTTNGACTATTGAAGGAAACTTCATCAAGTTCACTGCC : 240
TrCHIb2 : CTTGGTGGTGCAGGGGAGAGAGGTTNGACTATTGAAGGAAACTTCATCAAGTTCACTGCC : 239
TrCHIb3 : CTTGGTGGNCEAGGNNAGANNGNNTNGN-------------------------------- : 186

*        260         *        280         *        300
TrCHIb1 : ATAGGAGTATATTTGGAAGATGTAGCAGGGGCTTCACTTGCCACTAAATGGAAGGGNACA : 300
TrCHIb2 : ATAGGAGTATATTTGGAAGATGTAGCAGGGGCTTCACTTGCCACTAAATGGAAGGGCANA : 299
TrCHIb3 : ------------------------------------------------------------ :   -

*        320         *
TrCHIb1 : TCCTCTGAANAGNGNTTGANACCNTNGACTNN : 332
TrCHIb2 : TNCTCTGAAGAGNGCTTGAGACCCTNGACTNC : 331
TrCHIb3 : -------------------------------- :   -
```

FIGURE 6

```
                    *         20         *         40         *         60
TrCHIc : GTTAGNAGNAGNATNTCNGGCACCCTTTGAAAAGTTGATTCGAGGATCGAAGATTAGGGA :  60

*         80         *        100         *        120
TrCHIc : ATTGAGTGGTCCTGAGTACTCAAGGAAGGTTAATGAAAACTGCGTGGCACACTTAAAATC : 120

*        140         *        160         *        180
TrCHIc : TGTTGGGACTTATGGAGATGCAGAAGCTGAAGCTATGCAAAAATTTGTTGAAGCCTTCAA : 180

*        200         *        220         *        240
TrCHIc : GCCTATTAATTTTCCACCTGGTGCCTCTGTTTTTTACAGGCAATCACCTGATGGAATATT : 240

*        260         *
TrCHIc : AGGGGTTAGTATTGCCAATTCATTTTTTTTAACT : 274
```

FIGURE 7

```
                  *        20         *        40         *        60
TrCHIc : APFEKLIRGSKIRELSGPEYSRKVNENCVAHLKSVGTYGDAEAEAMQKFVEAFKPINFPP : 60

*        80         *
TrCHIc : GASVFYRQSPDGILGVSIANSFFLTILIRVRFDC : 94
```

FIGURE 8

```
              *         20         *         40         *         60
TrCHIc1 : GTTACNAGNATNNTTTCNGGCACCCTTTGAAAAGTTGATTCGAGGATCGAAGATTAGGGA :  60
TrCHIc2 : ----------GNATNTTTNGCACCCTTTGAAAAGTTGATTCGAGGATCGAAGATTAGGGA :  50

*         80         *        100         *        120
TrCHIc1 : ATTGAGTGGTCCTGAGTACTCAAGGAAGGTTAATGAAAACTGCGTGGCACACTTAAAATC : 120
TrCHIc2 : ATTGAGTGGTCCTGAGTACTCAAGGAAGGTTAATGAAAACTGCGTGGCACACTTAAAATC : 110

*        140         *        160         *        180
TrCHIc1 : TGTTGGGACTTATCGAGATGCAGAAGCTGAAGCTATGCAAAAATTTGTTGAAGCCTTCAA : 180
TrCHIc2 : TGTTGGGACTTATGGAGATGCAGAAGCTGAAGCTATGCAAAAATTTGTTGAAGCCTTCAA : 170

*        200         *        220         *        240
TrCHIc1 : GCCTATTAATTTTCCACCTGGTGCCTCTGTTTTTTACAGGCAATCACCTGATGGAATATT : 240
TrCHIc2 : GCCTATTAATTTTCCACCTGGTGCCTCTGTTTTTTACAGGCAATCACCTGATGGAATATT : 230

*        260         *
TrCHIc1 : AGGGGTTAGTATTGCCAATTCATTTTTTTTAACT : 274
TrCHIc2 : AGGGGTTAGTATTGCCAATTCATTTTTTTTAACT : 264
```

FIGURE 9

```
                    *        20         *        40         *        60
TrCHId : TTNANTNNNNTTNNCGGGCAATTACAACTACACAACACCTTCTCCATTACCATCTATCTT :  60

*        80         *       100         *       120
TrCHId : CTACTAAGTTCAACGAGATCAATGGCACTTCCTTCTGTCACCGCTTTGAATATCGAGAAC : 120

*       140         *       160         *       180
TrCHId : AATCTATTCCCTCCTACCGTCACACCACCGGGATCCACCAACAATTTCTTCCTCGGCGGT : 180

*       200         *       220         *       240
TrCHId : GCAGGAGAGCGGGGTCTTCAAATTCAAGACAAATTTGTCAAATTCACCGCTATTGGTGTT : 240

*       260         *       280         *       300
TrCHId : TATCTACAGGACATTGCTGTTCCTTACCTCGCCACTAAATGGAAGGGTAAGACTGCTCAA : 300

*       320         *       340         *       360
TrCHId : GAGCTAACGGAAACTGTTCCTTTCTTCAGGGACATCGTTACAGGTCCATTTGAGAAATTT : 360

*       380         *       400         *       420
TrCHId : ATGCAGGTGACAATGATCTTGCCATTGACTGGGCAACAATACTCAGAGAAAGTGTCAGAA : 420

*       440         *       460         *       480
TrCHId : AATTGTGTAGCTATTTGGAAGTCTCTTGGGATTTATACCGACGAAGAAGCCAAAGCAATT : 480

*       500         *       520         *       540
TrCHId : GAGAAGNNTGTTTCTGTCTTCAAAGANGAAACATTCCCACCAGGCTCCTCTATCCTTTTC : 540

*       560         *       580         *       600
TrCHId : ACAGNATTACCCAAAGGATTAGGATCACTAACGATAAGNTTCTCTAAAGATGGATCCATT : 600

*       620         *       640         *       660
TrCHId : CCAGAGACCGAGTCTGCAGTTATAGAGAATAAGCTACTCTCACAAGCTGTGCTNGAGTCG : 660

*       680         *       700         *       720
TrCHId : ATGATAGGGGCACACGGTGTCTCCCCTGCAGCAAAACAGAGTTTTGGCCACCAGGNTANC : 720

*       740         *       760         *       780
TrCHId : CGAGNTATTCAACGAGGNTGGCTGATGCCTAGCAACTTGATNATATCAACAAAACGAAAA : 780

*       800         *       820
TrCHId : TGAAAGNCCTTTTCTGCAATAAAGAACAAGCGGAAATTTTATTTT : 825
```

FIGURE 10

```
           *        20         *        40         *        60
TrCHId : MALPSVTALNIENNLFPPTVTPPGSTNNFFLGGAGERGLQIQDKFVKFTAIGVYLQDIAV :  60

*        80         *       100         *       120
TrCHId : PYLATKWKGKTAQELTETVPFFRDIVTGPFEKFMQVTMILPLTGQQYSEKVSENCVAIWK : 120

*       140         *       160         *       180
TrCHId : SLGIYTDEEAKAIEKVSVFKETFPPGSSILFTLPKGLGSLTIXFSKDGSIPETESAVIEN : 180

*       200         *       220         *
TrCHId : KLLSQAVXESMIGAHGVSPAAKQSFGHQXXRXIQRXWLMPSNLXISTKRK : 230
```

FIGURE 11

|         | * | 20 | * | 40 | * | 60 |   |     |
|---------|---|----|---|----|---|----|---|-----|
| TrCHId1: | TTNANTNNNNTTNNCGGTTTTNTNANAACTACACAACACCTTCT-TTTTTCCATTTATCTT | : | 59 |
| TrCHId2: | ---------------GCAATTACAACCTNNCAACACCTTCTCC-TTA-CNTCTATCTT | : | 41 |
| TrCHId3: | ------------------TTAC-ACT-CACAACACCTTCTCCATTACCATCTATCTT | : | 37 |
| TrCHId4: | -------------------------TCACATTATTACAATTACAACTTAACAT | : | 28 |

|         | * | 80 | * | 100 | * | 120 |   |     |
|---------|---|----|---|-----|---|-----|---|-----|
| TrCHId1: | CTACTAAGTTCAACGAGATCAATGGCACTTCCTTCTGTCNCCGCTTTGAATATCGAGAAC | : | 119 |
| TrCHId2: | CTACTAAGTTNAACGAGATCAATGGCACTTCCTTCTGTGACCGCTTTGAATATCCAGAAC | : | 101 |
| TrCHId3: | CTACTAAGTTCAACGAGATCAATGGCACTTCCTTCTGTCACCGCTTTGAATATCGAGAAC | : | 97 |
| TrCHId4: | TNACT-CGTANAAAGAGATNAATGGCACTTCCTTCTGTCACCGCTTTGGATATCCACAAC | : | 87 |

|         | * | 140 | * | 160 | * | 180 |   |     |
|---------|---|-----|---|-----|---|-----|---|-----|
| TrCHId1: | AATCTATTCCCTCCTACCGTCACACCANCGGGATCCACCAACAATTTCTTCCTCGGCGGT | : | 179 |
| TrCHId2: | AATCTATTCCCTCCTACCGTCACACCACCGGGATCCACCAACAATTTCTTCCTCGGCGGT | : | 161 |
| TrCHId3: | AATCTATTCCCTCCTACCGTCACACCACCGGGATCCACCAACAATTTCTTCCTCGGCGGT | : | 157 |
| TrCHId4: | AATCTATTCCCTCCNACCGTCACACCACCGGGATCCACTNACAANTTCTTCCTCGGCGGT | : | 147 |

|         | * | 200 | * | 220 | * | 240 |   |     |
|---------|---|-----|---|-----|---|-----|---|-----|
| TrCHId1: | GCAGGAGAGCGGGGTCTTCAAATTCAAGACAAATTTGTCAAATTCACCGNTATTGGTGTT | : | 239 |
| TrCHId2: | GCAGGAGAGCGGGGTCTTCAAATTCAAGACAAATTTGTNAAATTNACCGNTATTGGTGTT | : | 221 |
| TrCHId3: | GCAGGAGAGCGGGGTCTTCAAATTCAAGACAAATTTGTCAAATTCACCGCTATTGGTGTT | : | 217 |
| TrCHId4: | GCAGGACAGNCGGGTCTTCAAATNCAAGACAAATTNGTCAAATTCACCGCTATTGGTGTT | : | 207 |

|         | * | 260 | * | 280 | * | 300 |   |     |
|---------|---|-----|---|-----|---|-----|---|-----|
| TrCHId1: | TATCTACAGGACATTGCTGTTCCTTACCTCGCCACTAAATGGAAGGGTNAGACTGCTCAA | : | 299 |
| TrCHId2: | TATNTACNGGACNTTGNTGNNGNTTNCNTGGNNGNTNCNTGGANN--------------- | : | 266 |
| TrCHId3: | TATCTACAGGACATTGCTGTTCCTTACCTCGCCACTAAATGGAAGGGTAAGACTGCTCAA | : | 277 |
| TrCHId4: | TATCTNCAGGACATTGCTGTTCCTTACCTCGCANCTAAATGGAAGGGTAAGACTGCTCAA | : | 267 |

|         | * | 320 | * | 340 | * | 360 |   |     |
|---------|---|-----|---|-----|---|-----|---|-----|
| TrCHId1: | GAGCTAACGGAAACTGNNCCTTTCTTCAGGGACATNGNNACAGGTCCATTTGAGAAATTT | : | 359 |
| TrCHId2: | ------------------------------------------------------------ | : | - |
| TrCHId3: | GAGCTAACGGAAACTGTTCCTTTCTTCAGGGACATCGTTACAGGTCCATTTGAGAAATTT | : | 337 |
| TrCHId4: | GAGCTAACNNAAACTGTTCCTTTCTTCAGGGACATCGTTACAGGTCCATTTGAGAAATTT | : | 327 |

|         | * | 380 | * | 400 | * | 420 |   |     |
|---------|---|-----|---|-----|---|-----|---|-----|
| TrCHId1: | ATGCAGGTGACAATGATCTTGCCATTGACTGGGCAACAATACTCAGAGAAAGTGTCANAA | : | 419 |
| TrCHId2: | ------------------------------------------------------------ | : | - |
| TrCHId3: | ATGCAGGTGACAATGATCTTGCCATTGACTGGGCAACAATACTCAGAGAAAGTGTCAGAA | : | 397 |
| TrCHId4: | ATGCAGGTGACAATGATCTTGCCATTGACTGGGCAACAATACTCAGAGAAAGTGTCAGAA | : | 387 |

|         | * | 440 | * | 460 | * | 480 |   |     |
|---------|---|-----|---|-----|---|-----|---|-----|
| TrCHId1: | AATTGTGTANCTATNTGNAAGTCTCTTCGGATTTATACCGACCAAGAAGCCAAAGCAATT | : | 479 |
| TrCHId2: | ------------------------------------------------------------ | : | - |
| TrCHId3: | AATTGTGTAGCTATTTGGAAGTCTCTTGGGATTTATACCGACGAAGAAGCCAAAGCAATT | : | 457 |
| TrCHId4: | AATTGTGTAGCTATTTGGAAGTCTCTTCGGATATATACCGACGAACAANCCAAANCAATT | : | 447 |

FIGURE 12

```
                    *         500         *         520         *         540
TrCHId1 : GAGAAGNNTGTTTCTGTCTTCAAAGANGAAACATTCCCACCAGGCTCCTCTATCCTTTTC : 539
TrCHId2 : ------------------------------------------------------------ : -
TrCHId3 : GAGAAGTTTGTTTCTGTCTTCAAAGATGAAACATTCCCACCAGGCTCCTCTATCCTTTTC : 517
TrCHId4 : GANAANNNTGNTTCTGNTTNN--------------------------------------- : 468

*         560         *         580         *         600
TrCHId1 : ACAGNATTACCCAAAGGATTANGATCACTAACGATAAGNTTCTCTAAAGATGGATCCATT : 599
TrCHId2 : ------------------------------------------------------------ : -
TrCHId3 : ACAGTATTACCCAAAGGATTAGGATCACTAACGATAAGTTTCTCTAAAGATGGATCCATT : 577
TrCHId4 : ------------------------------------------------------------ : -

*         620         *         640         *         660
TrCHId1 : CCAGAGACCGAGTCTGCAGTTATAGNGAATAAGCTACTCTCACAAGCTGTGCTNGAGTCG : 659
TrCHId2 : ------------------------------------------------------------ : -
TrCHId3 : CCAGAGACCGAGTCTGCAGTTATAGAGAATAAGCTACTCTCACAAGCTGTGCTTGAGTCG : 637
TrCHId4 : ------------------------------------------------------------ : -

*         680         *         700         *         720
TrCHId1 : ATGATAGGGGCANNCGGTGTCTNNCNTGCANCAAANCATAGTTTTGNNCACCAGGNTANC : 719
TrCHId2 : ------------------------------------------------------------ : -
TrCHId3 : ATGATAGGGGCTCACGGTGTCTCCCCTGCAGCAAAACAGAG-TTTGGCCACCAGGTTATC : 696
TrCHId4 : ------------------------------------------------------------ : -

*         740         *         760         *         780
TrCHId1 : CNAGNTATTCAACGAGGNTGGCTGATGCCTAGCANCTTGATNNTNTNAACAAAACNAAAA : 779
TrCHId2 : ------------------------------------------------------------ : -
TrCHId3 : CGAGTTATTCAACGAGGTTGG-TGATG-CTAGCAAC-TGATTATATCAACAAAACGAAAA : 753
TrCHId4 : ------------------------------------------------------------ : -

*         800         *         820
TrCHId1 : TGNANGNCCTTTTCTGCATTAAAGAACA-------------------- : 807
TrCHId2 : ------------------------------------------------ : -
TrCHId3 : TGAAAGTCC-TTTCTGCAATAAAGAGCAAGCGGAAATTTTATTTT    : 797
TrCHId4 : ------------------------------------------------ : -
```

FIGURE 12 (cont)

```
                *        20         *        40         *        60
TrCHSa: TATTNTNNGAAACCACTTGTGTTGAAGNCGTGAACTTNGCTACCCTCCATATNATACTAT :   60

*        80         *       100         *       120
TrCHSa: NACCTCTTCTGAGACCCTTCATCATAGAAANACAACACACNTCAGCNCTTTGCTNTTTCT :  120

*       140         *       160         *       180
TrCHSa: ACAACAACCTATAACTANACATATTATTTTTATNTATTTAGTATATAATTGAAATAAACT :  180

*       200         *       220         *       240
TrCHSa: GCTAAAGATANTTATTAAGATATGGTGAGTGTAGCTGAAATTCGCAAGGCTCAGAGGGCT :  240

*       260         *       280         *       300
TrCHSa: GAAGGCCCTGCAACCATTTTGGCCATTGGCACTGCAAATCCAGCAAACCGTGTTGAGCAG :  300

*       320         *       340         *       360
TrCHSa: AGCACATATCCTGATTTCTACTTCAAAATCACAAACAGTGAGCACAAGACTGAGCTCAAA :  360

*       380         *       400         *       420
TrCHSa: GAGAAATTCCAGCGCATGTGTGACAAATCTATGATCAAGAGCAGATACATGTATCTAACA :  420

*       440         *       460         *       480
TrCHSa: GAAGAGATTTTGAAAGAAAATCCTAGTCTTTGTGAATACATGGCACCTTCATTGGATGCT :  480

*       500         *       520         *       540
TrCHSa: AGGCAAGACATGGTGGTGGTTGAGGTACCTAGACTTGGGAAGGAGGCTGCAGTGAAGGCT :  540

*       560         *       580         *       600
TrCHSa: ATTAAAGAATGGGGTCAACCAAAGTCAAAGATTACTCACTTAATCTTTTGCACCACAAGT :  600

*       620         *       640         *       660
TrCHSa: GGTGTAGACATGCCTGGTGCTGATTACCAACTCACAAAACTCTTAGGTCTTCGCCCATAT :  660

*       680         *       700         *       720
TrCHSa: GTGAAGAGGTACATGATGTACCAACAAGGGTGCTTTGCAGGTGGGACGGTGCTTCGTTTG :  720

*       740         *       760         *       780
TrCHSa: GCAAAAGATTTGGCCGAGAACAACAAAGGTGCTCGTGTGTTGGTTGTTTGTTCTGAAGTA :  780

*       800         *       820         *       840
TrCHSa: ACCGCAGTCACATTCCGCGGCCCCAGTGACACTCACTTGGACAGTCTTGTTGGACAAGCA :  840

*       860         *       880         *       900
TrCHSa: CTATTTGGAGATGGAGCTGCTGCACTCATTGTTGGCTCAGACCCAGTACCAGAAATTGAG :  900

*       920         *       940         *       960
TrCHSa: AAACCAATATTTGAGATGGTATGGACCGCACAGACAATTGCTCCAGACAGTGAAGGTGCC :  960

*       980         *      1000         *      1020
TrCHSa: ATTGATGGTCACCTTCGTGAAGCTGGACTAACATTTCATCTTCTTAAAGATGTTCCTGGG : 1020

*      1040         *      1060         *      1080
TrCHSa: ATTGTATCAAAGAACATTAATAAAGCATTGGTCGAGGCTTTCCAACCATTAGGAATTTCT : 1080

*      1100         *      1120         *
TrCHSa: GATTACAACTCAATCTTTTGGATTGCACACCCGGGTGGACCTGCAATTCT : 1130
```

FIGURE 13

```
             *        20         *        40         *        60
TrCHSa : MVSVAEIRKAQRAEGPATILAIGTANPANRVEQSTYPDFYFKITNSEHKTELKEKFQRMC :  60

*        80         *       100         *       120
TrCHSa : DKSMIKSRYMYLTEEILKENPSLCEYMAPSLDARQDMVVVEVPRLGKEAAVKAIKEWGQP : 120

*       140         *       160         *       180
TrCHSa : KSKITHLIFCTTSGVDMPGADYQLTKLLGLRPYVKRYMMYQQGCFAGGTVLRLAKDLAEN : 180

*       200         *       220         *       240
TrCHSa : NKGARVLVVCSEVTAVTFRGPSDTHLDSLVGQALFGDGAAALIVGSDPVPEIEKPIFEMV : 240

*       260         *       280         *       300
TrCHSa : WTAQTIAPDSEGAIDGHLREAGLTFHLLKDVPGIVSKNINKALVEAFQPLGISDYNSIFW : 300

TrCHSa : IAHPGGPAI : 309
```

FIGURE 14

```
                    *         20        *         40        *         60
TrCHSa1  : TATTNTNNGAAACCACTTGTGTTGAAGNCGTGAACTTNGCTACCCTCCATATNATACTAT :  60
TrCHSa2  : ------------------------------------------------------------ :   -
TrCHSa3  : ------------------------------------------------------------ :   -
TrCHSa4  : ------------------------------------------------------------ :   -
TrCHSa5  : ------------------------------------------------------------ :   -
TrCHSa6  : ------------------------------------------------------------ :   -
TrCHSa7  : ------------------------------------------------------------ :   -
TrCHSa8  : ------------------------------------------------------------ :   -
TrCHSa9  : ------------------------------------------------------------ :   -
TrCHSa10 : ------------------------------------------------------------ :   -
TrCHSa11 : ------------------------------------------------------------ :   -
TrCHSa12 : ------------------------------------------------------------ :   -
TrCHSa13 : ------------------------------------------------------------ :   -
TrCHSa14 : ------------------------------------------------------------ :   -
TrCHSa15 : ------------------------------------------------------------ :   -
TrCHSa16 : ------------------------------------------------------------ :   -
TrCHSa17 : ------------------------------------------------------------ :   -
TrCHSa18 : ------------------------------------------------------------ :   -
TrCHSa19 : ------------------------------------------------------------ :   -
TrCHSa20 : ------------------------------------------------------------ :   -
TrCHSa21 : ------------------------------------------------------------ :   -
TrCHSa22 : ------------------------------------------------------------ :   -
TrCHSa23 : ------------------------------------------------------------ :   -
TrCHSa24 : ------------------------------------------------------------ :   -
TrCHSa25 : ------------------------------------------------------------ :   -
TrCHSa26 : ------------------------------------------------------------ :   -
TrCHSa27 : ------------------------------------------------------------ :   -
TrCHSa28 : ------------------------------------------------------------ :   -
TrCHSa29 : ------------------------------------------------------------ :   -
TrCHSa30 : ------------------------------------------------------------ :   -
TrCHSa31 : ------------------------------------------------------------ :   -
TrCHSa32 : ------------------------------------------------------------ :   -
TrCHSa33 : ------------------------------------------------------------ :   -
TrCHSa34 : ------------------------------------------------------------ :   -
TrCHSa35 : ------------------------------------------------------------ :   -
TrCHSa36 : ------------------------------------------------------------ :   -
TrCHSa37 : ------------------------------------------------------------ :   -
TrCHSa38 : ------------------------------------------------------------ :   -
TrCHSa39 : ------------------------------------------------------------ :   -
```

FIGURE 15

```
                         *        80         *       100         *       120
TrCHSa1  : NACCTCTTCTGAGACCCTTCATCATATATATATAACNCATCTCACCTCATACATATTTCC :120
TrCHSa2  : -----------------------GNANNACAACACACTTCNAC-CTTTGCT-TTTCT :  32
TrCHSa3  : ----------------------------------CACNTTAGCNCTTTGCTNTTTCT :  23
TrCHSa4  : ----------------------------------CACNTTAGC-CTTTGCT-TTTCT :  21
TrCHSa5  : ------------------------------------------------GCANACACT :   9
TrCHSa6  : ---------------------------------------------------------ACN :   3
TrCHSa7  : ----------------------------------------------------------CC :   2
TrCHSa8  : ----------------------------------------------------------CN :   2
TrCHSa9  : ----------------------------------------------------------GC :   2
TrCHSa10 : ----------------------------------------------------------- :   -
TrCHSa11 : ----------------------------------------------------------- :   -
TrCHSa12 : ----------------------------------------------------------- :   -
TrCHSa13 : ----------------------------------------------------------- :   -
TrCHSa14 : ----------------------------------------------------------- :   -
TrCHSa15 : ----------------------------------------------------------- :   -
TrCHSa16 : ----------------------------------------------------------- :   -
TrCHSa17 : ----------------------------------------------------------- :   -
TrCHSa18 : ----------------------------------------------------------- :   -
TrCHSa19 : ----------------------------------------------------------- :   -
TrCHSa20 : ----------------------------------------------------------- :   -
TrCHSa21 : ----------------------------------------------------------- :   -
TrCHSa22 : ----------------------------------------------------------- :   -
TrCHSa23 : ----------------------------------------------------------- :   -
TrCHSa24 : ----------------------------------------------------------- :   -
TrCHSa25 : ----------------------------------------------------------- :   -
TrCHSa26 : ----------------------------------------------------------- :   -
TrCHSa27 : ----------------------------------------------------------- :   -
TrCHSa28 : ----------------------------------------------------------- :   -
TrCHSa29 : ----------------------------------------------------------- :   -
TrCHSa30 : ----------------------------------------------------------- :   -
TrCHSa31 : ----------------------------------------------------------- :   -
TrCHSa32 : ----------------------------------------------------------- :   -
TrCHSa33 : ----------------------------------------------------------- :   -
TrCHSa34 : ----------------------------------------------------------- :   -
TrCHSa35 : ----------------------------------------------------------- :   -
TrCHSa36 : ----------------------------------------------------------- :   -
TrCHSa37 : ----------------------------------------------------------- :   -
TrCHSa38 : ----------------------------------------------------------- :   -
TrCHSa39 : ----------------------------------------------------------- :   -
```

```
               *         260         *         280         *         300
TrCHSa1  : GAAGGCCCTGCAACTATTTTGGCCATTGGTACTGCAAATCCAGCAAATCGTGTTGACCAG :300
TrCHSa2  : GAAGGCCCTGCAACTATTTTGGCCATTGGCACTGCAAATCCAGCAAACCGTGTTGATCAG :197
TrCHSa3  : GAAGGCCCTGCAACAATCTTGGCCATTGGCACTGCAAATCCAGCAAACCGTGTTGATCAG :203
TrCHSa4  : GAAGGCCCTGCAACAATCTTGGCCATTGGCACTGCAAATCCAGCAAACCGTGTTGATCAG :188
TrCHSa5  : GAAGGCCCTGCAACCATTTTAGCCATTGGTACTGCAAATCCAGCAAACCGTGTAGACCAG :189
TrCHSa6  : GAAGGCCCTGCAACCATTTTGGCCATTGGCACTGCAAATCCACCAAACCGTGTTGAGCAG :176
TrCHSa7  : GAAGGCCCTGCAACCATTTTGGCCATTGGCACTGCAAATCCACCAAACCGTGTTGAGCAG :182
TrCHSa8  : GAAGGCCCTGCAACCATTTTGGCCATTGGCACTGCAAATCCACCAAACCGTGTTGAGCAG :176
TrCHSa9  : GAAGGCCCTGCAACCATTTTGGCCATTGGCACTGCAAATCCACCAAACCGTGTTGAGCAG :182
TrCHSa10 : GAAGGCCCTGCAACTATTTTGGCCATTGGCACTGCAAATCCAGCAAACCGTGTTGATCAG :180
TrCHSa11 : GAAGGCCCTGCAACCATTTTGGCCATTGCTACTGCAAATCCACCAAACCGTGTTGACCGG :171
TrCHSa12 : GAAGGCCCTGCAACTATTTTGGCCATTGGTACTGCAAATCCAGCAAATCGTGTTGACCAG :170
TrCHSa13 : GAAGGCCCTGCAACTATTTTGGCCATTGGTACTGCAAATCCAGCAAATCGTGTTGACCAG :179
TrCHSa14 : GAAGGCCCTGCAACCATTTTGGCCATTGGCACTGCAAATCCACCAAACCGTGTTGAGCAG :177
TrCHSa15 : CAAGGCCCTGCAACCATTTTGGCCATTGCTACTGCAAATCCAGCAAACCGTGTTGACCAG :170
TrCHSa16 : GAAGGCCCTGCAACCATTTTGGCCATTGGCACTGCAAATCCAGCAAACCGTGTTGAGCAG :178
TrCHSa17 : GAAGGCCCTGCAACTATTTTGGCCATTGGTACTGCAAATCCAGCAAACCGTGTTGACCAG :177
TrCHSa18 : GAAGGCCCTGCAACTATTTTGGCCATTGGTACTGCAAATCCAGCAAACCGTGTTGATCAG :176
TrCHSa19 : GAAGGCCCTGCAACCATTTTGGCCATTGGCACTGCAAATCCACCAAACCGTGTTGAGCAG :175
TrCHSa20 : GAAGGCCCTGCAACCATTTTGGCCATTGGCACTGCAAATCCATCAAACCGTGTTGAGCAG :173
TrCHSa21 : GAAGGCCCTGCAACCATTTTGGCCATTGGCACTGCAAATCCACCAAACCGGGTTGAGCAG :172
TrCHSa22 : GAAGGCCCTGCAACCATTTTGGCCATTGGCACTGCAAATCCACCAAACCGTGTTGAGCAG :169
TrCHSa23 : GAAGGCCCTGCAACCATTTTGGCCATTGGTACTGCAAATCCAGCAAACCGTGTTGATCAG :163
TrCHSa24 : GAAGGCCCTGCAACCATTTTGGCCATTGGTACTGCAAATCCAGCAAACCGTGTTGATCAG :167
TrCHSa25 : GAAGGCCCTGCAACCATTTTGGCCATTGGCACTGCAAATCCATCAAACCGTGTTGAGCAG :167
TrCHSa26 : GAAGGCCCTGCAACCATTTTGGCCATTGGTACTGCAAATCCACCAAACCGTGTTGATCAG :158
TrCHSa27 : GAAGGCCCTGCAACTATTTTGGCCATTGGTACTGCAAATCCAGCAAACCGTGTTGATCAG :155
TrCHSa28 : GAAGGCCCTGCAACTATTTTGGCCATTGGTACTGCAAATCCAGCAAACCGTGTTGATCAA :162
TrCHSa29 : GAAGGCCCTGCAACCATTTTGGCCATTGGCACTGCAAATCCATCAAACCGTGTTGAGCAG :137
TrCHSa30 : CAAGGCCCTGCAACCATTTTGGCCATTGGCACTGCAAATCCAGCAAACCGTGTTGAGCAG :121
TrCHSa31 : GAAGGCCCTGCAACCATTTTGGCCATTGGCACTGCAAATCCATCAAACCGTGTTGAGCAG :118
TrCHSa32 : GAAGGCCCTGCAACCATTTTGGCCATTGGCACTGCAAATCCACCAAACCGTGTTGAGCAG :118
TrCHSa33 : GAAGGCCCTGCAACCATTTTGGCCATTGGCACTGCAAATCCACCAAACCGTGTTGAGCAG :118
TrCHSa34 : GAAGGCCCTGCAACC-TTTTGGCCGTTGGCACTGCAAATCC-GCAAACCGTGTTGAGCAG : 71
TrCHSa35 : -----------ANCNTTTTGGCCGTTGGTACTGCAAATCCNGCAAATCGTGTTGACCNG  : 59
TrCHSa36 : -----------ACCNTTTTGGCCGTTGGTACTGCAAATCCNGCAAATCGTGTTGACCAG  : 57
TrCHSa37 : ------------------------------------------------------------ :  -
TrCHSa38 : ------------------------------------------------------------ :  -
TrCHSa39 : ------------------------------------------------------------ :  -
```

FIGURE 15 (cont)

|  | * 320 * 340 * 360 |  |
|---|---|---|
| TrCHSa1  : | AGTACATATCCTGATTTCTACTTCAAAATCACTAACAGTGAGCATAAGGTTGAGCTTAAA | :360 |
| TrCHSa2  : | AGTACATATCCTGATTTCTACTTCAAAATCACTAACAGTGAGCATAAAGTTGAGCTCAAA | :257 |
| TrCHSa3  : | AGCACATATCCTGATTTCTACTTCAAAATCACTAACAGTGAACATAAAGTTGAGCTCAAA | :263 |
| TrCHSa4  : | AGCACATATCCTGATTTCTACTTCAAAATCACTAACAGTGAGCACAAGACTGAGCTCAAA | :248 |
| TrCHSa5  : | AGCACATATCCTGATTTCTACTTCAAAATCACTAACAGTGAGCATAAGGTTGAGCTTAAA | :249 |
| TrCHSa6  : | AGCACATATCCTGATTTCTACTTCAAAATTACAAACAGTGAGCACAAGACTGAGCTCAAA | :236 |
| TrCHSa7  : | AGCACATATCCTGATTTCTACTTCAAAATTACAAACAGTGAGCACAAGACTGAGCTCAAA | :242 |
| TrCHSa8  : | AGCACATATCCTGATTTCTACTTCAAAATTACAAACAGTGAGCACAAGACTGAGCTCAAA | :236 |
| TrCHSa9  : | AGCACATATCCTGATTTCTACTTCAAAATTACAAACAGTGAGCACAAGACTGAGCTCAAA | :242 |
| TrCHSa10: | AGCACATATCCTGATTTTTACTTCAAAATCACTAACAGTGAGCATAAGGTTGAGCTTAAA | :240 |
| TrCHSa11: | AGCACATATCCTGATTTCTACTTCAAAATTACAAACAGTGAGCACAAGACTGAGCTCAAA | :231 |
| TrCHSa12: | AGTACATATCCTGATTTCTACTTCAAAATCACTAACAGTGAGCATAAGGTTGAGCTTAAA | :230 |
| TrCHSa13: | AGTACATATCCTGATTTCTACTTCAAAATCACTAACAGTGAGCATAAGGTTGAGCTTAAA | :239 |
| TrCHSa14: | AGCACATATCCTGATTTCTACTTCAAAATTACAAACAGTGAGCACAAGACTGAGCTCAAA | :237 |
| TrCHSa15: | AGTACATATCCTGATTTCTACTTCAAAATCACTAACAGTGAGCATAAGGTTGAGCTTAAA | :230 |
| TrCHSa16: | AGCACATATCCTGATTTCTACTTCAAAATTACAAACAGTGAGCACAAGACTGAGCTCAAA | :238 |
| TrCHSa17: | AGTACATATCCTGATTTCTACTTCAAAATCACTAACAGTGAGCATAAGGTTGAGCTTAAA | :237 |
| TrCHSa18: | AGTACATATCCTGATTTCTACTTCAAAATCACTAACAGTGAGCATAAGGTTGAGCTCAAA | :236 |
| TrCHSa19: | AGCACATATCCTGATTTCTACTTCAAAATTACAAACAGTGAGCACAAGACTGAGCTCAAA | :235 |
| TrCHSa20: | AGCACATATCCTGATTTCTACTTCAAAATTACAAACAGTGAGCACAAGACTGAGCTCAAA | :233 |
| TrCHSa21: | AGCACATATCCTGATTTCTACTTCAAAATTACAAACAGTGAGCACAAGACTGAGCTCAAA | :232 |
| TrCHSa22: | AGCACATATCCTGATTTCTACTTCAAAATTACAAACAGTGAGCACAAGACTGAGCTCAAA | :229 |
| TrCHSa23: | AGTACATATCCTGATTTCTACTTCAAAATCACTAACAGTGAGCATAAGGTTGAGCTCAAG | :223 |
| TrCHSa24: | AGTACATATCCTGATTTCTACTTCAAAATCACTAACAGTGAGCATAAGGTTGAGCTCAAG | :227 |
| TrCHSa25: | AGCACATATCCTGATTTCTACTTCAAAATTACAAACAGTGAGCACAAGACTGAGCTCAAA | :227 |
| TrCHSa26: | AGTACATATCCTGATTTCTACTTCAAAATCACTAACAGTGAGCATAAGGTTGAGCTCAAG | :218 |
| TrCHSa27: | AGTACATATCCTGATTTCTACTTCAAAATCACTAACAGTGAGCATAAGGTTGAGCTCAAA | :215 |
| TrCHSa28: | AGTACATATCCTGATTTCTACTTCAAAATCACTAACAGTGAGCATAAGGTTGAGCTCAAA | :222 |
| TrCHSa29: | AGCACATATCCTGATTTCTACTTCAAAATTACAAACAGTGAGCACAAGACTGAGCTCAAA | :197 |
| TrCHSa30: | AGCACATATCCTGATTTCTACTTCAAAATTACAAACAGTGAGCACAAGACTGAGCTCAAA | :181 |
| TrCHSa31: | AGCACATATCCTGATTTCTACTTCAAAATTACAAACAGTGAGCACAAGACTGAGCTCAAA | :178 |
| TrCHSa32: | AGCACATATCCTGATTTCTACTTCAAAATTACAAACAGTGAGCACAAGACTGAGCTCAAA | :178 |
| TrCHSa33: | AGCACATATCCTGATTTCTACTTCAAAATTACAAACAGTGAGCACAAGACTGAGCTCAAA | :178 |
| TrCHSa34: | AGCACATATCCTGATTTCTACTTCAAAATTACAAACAGTGAGCACAAGACTGAGCTCAAA | :131 |
| TrCHSa35: | AGTACATATCCTGATTTCTACTTCAAAATCACTAACAGTGAGCATAAGATTGAGCTTAAA | :119 |
| TrCHSa36: | AGTACATATCCTGATTTCTACTTCAAAATCACTAACAGTGAGCATAAGGTTGAGCTTAAA | :117 |
| TrCHSa37: | ------------------------------------GCTGAGCTTAAA | : 17 |
| TrCHSa38: | ------------------------------------------------------------ | : - |
| TrCHSa39: | ------------------------------------------------------------ | : - |

```
              *        440         *        460         *        480
TrCHSa1  : GAAGAGATTTTGAAAGAAAATCCTAGTCTTTCTGAATACATGGCACCTTCATTGGATGCT :480
TrCHSa2  : GAAGAGATTTTGAAAGAAAATCCTAGTCTTTGTGAATACATGGCACCTTCATTGGATGCT :377
TrCHSa3  : GAAGAGATTTTGAAAGAAAATCCTAGTCTTTGTGAGCACATGGCACCTTCATTGGATGCT :383
TrCHSa4  : GAAGAGATTTTGAAAGAAAATCCTAGTCTTTGTGAGCACATGGCACCTTCATTGGATGCT :368
TrCHSa5  : GAAGAGATTTTGAAAGAAAATCCTAGTCTTTGTGAATACATGGCACCTTCATTGGATGCT :369
TrCHSa6  : GAAGAGATTTTGAAAGAAAATCCTAGTCTTTGTGAATACATGGCACCTTCATTGGATGCT :356
TrCHSa7  : GAAGAGATTTTGAAAGAAAATCCTAGNCTTTGTGAATACATGNCACCTTCATTGGATGCT :362
TrCHSa8  : GAAGAGATTTTGAAAGAAAATCCTAGTCTTTGTGAATACATGGCACCTTCATTGGATGCT :356
TrCHSa9  : GAAGAGATTTTGAAAGAAAATCCTAGTCTTTGTGAATACATGGCACCTTCATTGGATGCT :362
TrCHSa10 : GAAGAGATTTTGAAAGAAAATCCTAGTCTTTGTGAATACATGGCACCTTCATTGGATGCT :360
TrCHSa11 : GAAGAGATTTTGAAAGAAAATCCTAGTCTTTGTGAATACATGGCACCTTCATTGGATGCT :351
TrCHSa12 : GAAGAGATTTTGAAAGAAAATCCTAGTCTTTGTGAATACATGGCACCTTCATTGGATGCT :350
TrCHSa13 : GAAGAGATTTTGAAAGAAAATCCTAGTCTTTGTGAATACATGGCACCTTCATTGGATGCT :359
TrCHSa14 : GAAGAGATTTTGAAAGAAAATCCTAGTCTTTGTGAATACATGGCACCTTCATTGGATGCT :357
TrCHSa15 : GAAGAGATTTTGAAAGAAAATCCTAGTCTTTGTGAATACATGGNACCTTCATTGNATGNT :350
TrCHSa16 : GAAGAGATTTTGAAAGAAAATCCTAGTCTTTGTGAATACATGGCACCTTCATTGGATGCT :358
TrCHSa17 : GAAGAGATTTTGAAAGAAAATCCTAGTCTTTGTGAATACATGGCACCTTCATTGGATGCT :357
TrCHSa18 : GAAGAGATTTTGAAAGAAAATCCTAGTCTTTGTGAATACATGGCACCTTCATTGGATGCT :356
TrCHSa19 : GAAGAGATTTTGAAAGAAAATCCTAGTCTTTGTGAATACATGGCACCTTCATTGGATGCT :355
TrCHSa20 : GAAGAGATTTTGAAAGAAAATCCTAGTCTTTGTGAATACATGGCACCTTCATTGGATGCT :353
TrCHSa21 : GAAGAGATTTTGAAAGAAAATCCTAGTCTTTGTGAATACATGGCACCTTCATTGGATGCT :352
TrCHSa22 : GAAGAGATTTTGAAAGAAAATCCTAGTCTTTGTGAATACATGGCACCTTCATTGGATGCT :349
TrCHSa23 : GAAGAGATTTTGAAAGAAAATCCTAGTCTTTGTGAATACATGGCACCTTCATTGGATGCT :343
TrCHSa24 : GAAGAGATTTTGAAAGAAAATCCTAGTCTGTGTGAGTACATGGCACCTTCATTGGATGCT :347
TrCHSa25 : GAAGAGATTTTGAAAGAAAATCCTAGTCTTTGTGAATACATGGCACCTTCATTGGATGCT :347
TrCHSa26 : GAAGAGATTTTGAAAGAAAATCCTAGTCTGTGTGAGTACATGGCACCTTCATTGGATGCT :338
TrCHSa27 : GAAGAGATTTTGAAAGAAAATCCTAGTCTTTGTGAATACATGGCACCTTCATTGGATGCT :335
TrCHSa28 : GAAGAGATTTTGAAAGAAAATCCTAGTCTTTGTGAATACATGGCACCTTCATTGGATGCT :342
TrCHSa29 : GAAGAGATTTTGAAAGAAAATCCTAGTCTTTGTGAATACATGGCACCTTCATTGGATGCT :317
TrCHSa30 : GAAGAGATTTTGAAAGAAAATCCTAGTCTTTGTGAATACATGGCACCTTCATTGGATGCT :301
TrCHSa31 : GAAGAGATTTTGAAAGAAAATCCTAGTCTTTGTGAATACATGGCACCTTCATTGGATGCT :298
TrCHSa32 : GAAGAGATTTTGAAAGAAAATCCTAGTCTTTGTGAATACATGGCACCTTCATTGGATGCT :298
TrCHSa33 : GAAGAGATTTTGAAAGAAAATCCTAGTCTTTGTGAATACATGGCACCTTCATTGGATGCT :298
TrCHSa34 : GAAGAGATTTTGAAAGAAAATCCTAGTCTTTGTGAATACATGGCACCTTCATTGGATGCT :251
TrCHSa35 : GAAGAGATTTTGAAAGAAAATCCTAGTCTTTGTGAATACATGGCACCTTCATTGGATGCT :239
TrCHSa36 : GAAGAGATTTTGAAAGAAAATCCTAGTCTTTGTGAATACATGGCACCTTCATTGGATGCT :237
TrCHSa37 : GAAGAGATTTTGAAAGAAAATCCTAGTCTTTGTGAATACATGGCACCTTCATTGGATGCT :137
TrCHSa38 : GAAGAGATTTTGAAAGAAAATCCTAGTCTGTGTGAGTACATGGCACCTTCATTGGATGCT : 87
TrCHSa39 : ------------------------------------------------------------ :
```

FIGURE 15 (cont)

```
                      *         500         *         520         *         540
TrCHSa1  : AGGCAAGACATGGTGGTGGTTGAGGTACCTAGACTTGGGAAGGAGGCTGCAGTGAAAGCT :540
TrCHSa2  : AGGCAAGATATGGTGGTGGTTGAGGTACCTAGACTTGGAAAGGAGGCTGCAGTGAAGGCT :437
TrCHSa3  : AGGCAAGACATGGTGGTGGTTGAGGTACCTAGACTTGGGAAGGAGGCTGCAGTGAAAGCT :443
TrCHSa4  : AGGCAAGACATGGTGGTGGTTGAGGTACCTAGACTTGGGAAGGAGGCTGCAGTGAAAGCT :428
TrCHSa5  : AGGCAAGACATGGTGGTGGTTGAGGTACCTAGACTAGGAAAGGAGGCTGCAGTCAAGGCC :429
TrCHSa6  : AGGCAAGACATGGTGGTGGTTGAGGTACCTAGACTTGGGAAGGAGGCTGCAGTCAAGGCC :416
TrCHSa7  : AGNCAAGACATGGTGNCGCCNNANNNNCCACGCTCGCNGGCCN---------------- :407
TrCHSa8  : AGGCAAGACATGGTGGTGGTTGAGGTACCTANACTTGGGAAGGAGGCTGCANNCAAGGCC :416
TrCHSa9  : AGACAAGACATGGTGGTGGTTGAGGTACCTAGACTTGGGAAGGAGGCTGCAGTCAAGGCT :422
TrCHSa10 : AGGCAAGACATGGTGGTGGTTGAGGTACCTAGACTTGGGAAGGAGGCTGCAGTGAAAGCT :420
TrCHSa11 : AGGCAAGACATGGTGGTGGTTGAGGTACCTAGACTTGGGAAGGAGGCTGCAGTGAAAGCT :411
TrCHSa12 : AGGCAAGACATGGTGGTGGTTGAGGTACCTAGACTTGGGAAGGAGGCTGCAGTGAAAGCT :410
TrCHSa13 : AGGCAAGACATGGTGGTGGTTGAGGTACCTAGACTTGGGAAGGAGGCTGCAGTCAAGGCC :419
TrCHSa14 : AGGCAAGACATGGTGGTGGTTGAGGTACCTAGACTTGGGAAGGAGGCTGCAGTCAAGGCC :417
TrCHSa15 : AGNCAAGACATGNTGNTGNGNGAGGNACCNAGACTTGGCN-------------------- :390
TrCHSa16 : AGACAAGACATGGTGGTGGTTGAGGTACCTAGACTTGGGAAGGAGGCTGCAGTCAAGGCT :418
TrCHSa17 : AGGCAAGACATGGTGGTGGTTGAGGTACCTAGACTTGGCAACCGACGCTGCAGTGAAAGCT :417
TrCHSa18 : AGGCAAGAAATGGTGGCNGTTGAGGTACCTANACTTGNNAAGGAGGCTGCNNTGAAGGCT :416
TrCHSa19 : AGGCAAGACATGGTGGTGGTTGAGGTACCTAGACTTGGGAAGGAGGCTGCAGTGAAAGCT :415
TrCHSa20 : AGGCAAGACATGGTGGTGGTTGAGGTACCTAGACTTGGGAAGGAGGCTGCAGTCAAGGCC :413
TrCHSa21 : AGGCAAGACATGGTGGTGGTTGAGGTACCTAGACTTGGGAAGGAGGCTGCAGTCAAGGCT :412
TrCHSa22 : AGGCAAGACATGGTGGTGGTTGAGGTACCTAGACTTGGGAAGGAGCTGCAGTCAAGGCC :409
TrCHSa23 : AGGCAAGAAATGGTGGTAGTTGAGGTACCTAGACTGGGAAGGANGCTGCAGTGAAGGCT :403
TrCHSa24 : AGGCAAGACATGGTAGTGGTTGAGGTACCTAGACTTGGAAAGGAGGCTGCAGTCAAGGCC :407
TrCHSa25 : AGGCAAGACATGGTGGTGGTTGAGGTACCTAGACTTGGGAAGGAGGCTGCAGTCAAGGCC :407
TrCHSa26 : AGGCAAGACATGGTAGTGGTTGAGGTACCTAGACTTGGAAAGGAGGCTGCAGTAAAGGCC :398
TrCHSa27 : AGACAAGACATGGTGGTGGTTGAGGTACCTAGACTTGGAAAGGAGGCTGCAGTGAAGGCC :395
TrCHSa28 : AGACAAGACATGGTGGTGGTTGAGGTACCTAGACTTCCAAAGGAGGCTGCAGTGAAGGCC :402
TrCHSa29 : AGGCAAGACATGGTGGTGGTTGAGGTACCTAGACTTGGGAAGGAGGCTGCAGTGAAAGCT :377
TrCHSa30 : AGGCAAGACATGGTGGTGGTTGAGGTACCTAGACTTGGGAAGGAGGCTGCAGNGNAGGCC :361
TrCHSa31 : AGGCAAGACATGGTGGTGGTTGAGGTACCTAGACTTGGGAAGGAGGCTGCAGTCAAGGCC :358
TrCHSa32 : AGGCAAGACATGGTGGTGGTTGAGGTACCTAGACTTGGGAAGGAGGCTGCAGTGAANGCT :358
TrCHSa33 : AGACAAGACATGGTGGTGGTTGAGGTACCTAGACTTGGGAAGGAGGCTGCAGTCAAGGCT :358
TrCHSa34 : AGACAAGACATGGTGGTGGTTGAGGTACCTAGACTTGGGAAGGAGGCGGCAGTCAAGGCT :311
TrCHSa35 : AGGCAAGACATGGTGGTGGTTGAGGTACCTAGACTTGGGAAGGAGGCTGCAGTCAAACCT :299
TrCHSa36 : AGGCAAGACATGGTGGTGGTTGAGGTACCTAGACTTGGGAAGGAGGCTGCAGTGAAAGCT :297
TrCHSa37 : AGGCAAGACATGGTGGTGGTTGAGGTACCTAGACTTGGGAAGGAGGCTGCAGTGAAAGCT :197
TrCHSa38 : AGGCAAGACATGGTTGTGGTTGAGGTACCTAGACTTGGAAAGGAGGCTGCAGTCAAGGCC :147
TrCHSa39 : ------------------------------------------------------------ : -
```

FIGURE 15 (cont)

```
                        *         560         *         580         *         600
TrCHSa1  : ATCAAAGAATGGGGTCAACCAAAGTCAAAGATTACTCACTTAATCTTTTGCACCACAAGT : 600
TrCHSa2  : ATTAAAGAATGGGGTCAACCAAAATCTAAGATTACACATTTGATCTTTTGCACCACAAGT : 497
TrCHSa3  : ATAAAAGAATGGGGTCAACCAAAGTCAAAGATTACTCACTTAATCTTTTGCACCACAAGT : 503
TrCHSa4  : ATAAAAGAATGGGGTCAACCAAAGTCAAAGATTACTCACTTAATCTTTTGCACCACAAGT : 488
TrCHSa5  : ATTAAAGAATGGGGTCAACCAAAGTCAAAGATTACTCACTTAATCTTTTGCACCACAAGT : 489
TrCHSa6  : ATTAAAGAATGGGGTCAACCAAAGTCAAAGATTACTCACTTAATCTTTTGCACCACAAGT : 476
TrCHSa7  : ------------------------------------------------------------ :  -
TrCHSa8  : ATTAAAGAATGGGGTCAACCAAAGTCANAGATNACTNACTTAATCTTTTGCACCACAAGN : 476
TrCHSa9  : ATCAAAGAATGGGGTCAACCAAAATCTAAGATTACACATTTGATCTTTTGCACCACAAGT : 482
TrCHSa10 : ATCAAAGAATGGGGTCAACCAAAGTCAAAGATTACTCACTTAATCTTTTGCACCACAAGT : 480
TrCHSa11 : ATCAAAGAATGGGGTCAACCAAAGTCAAAGATTACTCACTTAATCTTTTGCACCACAAGT : 471
TrCHSa12 : ATCAAAGAATGGGGTCAACCAAAGTCAAAGATTACTCACTTAATCTTTTGCACCACAAGT : 470
TrCHSa13 : ATCAAAGAATGGGGTCAACCAAAGTCAAAGATTACTCACTTAATCTTTTGCACCACAAGT : 479
TrCHSa14 : ATCAAAGAATGGGGTCAACCAAAGTCAAAGATTACTCACTTAATCTTTTGCACCACAAGT : 477
TrCHSa15 : ------------------------------------------------------------ :  -
TrCHSa16 : ATCAAAGAATGGGGTCAACCAAAATCTAAGATTACACATTTGATCTTTTGCACCACAAGT : 478
TrCHSa17 : ATCAAAGAATGGGGTCAACCAAAGTCAAAGATTACTCACTTAATCTTTTGCACCACAAGT : 477
TrCHSa18 : ATTAAAGAATGGCGCCANCCN--------------------------------------- : 437
TrCHSa19 : ATCAAAGAATGGGGTCAACCAAAGTCAAAGATTACTCACTTAATCTTTTGCACCACAAGT : 475
TrCHSa20 : ATTAAAGAATGGGGTCAACCAAAGTCAAAGATTACTCACTTAATCTTTTGCACCACAAGT : 473
TrCHSa21 : ATCAAAGAATGGGGTCAACCAAAATCTAAGATTACACATTTGATCTTTTGCACCACAAGT : 472
TrCHSa22 : ATTAAAGAATGGGGTCACCCAAAGTCAAAGATTACTCACTTAATCTTTTGCACCACAAGT : 469
TrCHSa23 : ATTAAAGAATGGGGTCAACCAAAGTCAAAGATTACTCACTTAATCTTTTGCACCACAAGT : 463
TrCHSa24 : ATTAAAGAATGGGGTCAACCAAAGTCAAAGATTACTCACTTAATCTTTTGCACCACAAGT : 467
TrCHSa25 : ATTAAAGAATGGGGTCAACCAAAGTCAAAGATTACTCACTTAATCTTTTGCACCACAAGT : 467
TrCHSa26 : ATTAAAGAATGGGGTCAACCAAAGTCAAAGATTACTCACTTAATCTTTTGCACCACAAGT : 458
TrCHSa27 : ATTAAAGAATGGGGTCAACCAAAATCTAAGATTACACATTTGATCTTTTGCACCACAAGT : 455
TrCHSa28 : ATTAAAGAATGGGGTCAACCAAAATCTAAGATTACACATTTGATCTTTTGCACCACAAGT : 462
TrCHSa29 : ATAAAAGAATGGGGTCAACCAAAGTCAAAGATTACTCACTTAATCTTTTGCACCACAAGT : 437
TrCHSa30 : ATTAAANAATGGGNCNACCAAAGNCAAAGATTACTCACTTAATCTTTTGCACCACAAGT : 421
TrCHSa31 : ATTAAAGAATGGGGTNAACCAAAGTNAAAGATTACTNACTTAATCTTTTGCACCACAAGT : 418
TrCHSa32 : ATTAAAGAATGGGGTCAACCAAAGTCAAAGATTACTCACTTAATCTTTTGCACCACAAGT : 418
TrCHSa33 : ATCAAAGAATGGGGTCAACCAAAATCTAAGATTACACATTTGATCTTTTGCACCACAAGT : 418
TrCHSa34 : ATCAAAGAATGGGGTCAACCAAAATCTAAGATTACACATTTGATCTTTTGCACCACAAGT : 371
TrCHSa35 : ATCAAAGAATGGGGTCAACCAAAGTCAAAGATTACTCACTTAATCTTTTGCACCACAAGT : 359
TrCHSa36 : ATCAAAGAATGGGGTCAACCAAAGTCAAAGATTACTCACTTAATCTTTTGCACCACAAGT : 357
TrCHSa37 : ATCAAAGAATGGGGTCAACCAAAGTCAAAGATTACTCACTTAATCTTTTGCACCACAAGT : 257
TrCHSa38 : ATTAAAGAATGGGGTCAACCAAAGTCAAAGATTACTCACTTAATCTTTTGCACCACAAGT : 207
TrCHSa39 : ---NAAGAATGGGGNCNACCNAANTCNAAGANTNCNCANTTGATCTTTTGCACCACAAGT :  61
```

FIGURE 15 (cont)

```
            *         620         *         640         *         660
TrCHSa1  : GGTGTTGACATGCCTGGTGCTGATTACCAACTCACAAAACTCTTAGGTCTTCGCCCATAT :660
TrCHSa2  : GGTGTAGACATGCCTGGTGCTGATTACCAGCCCACAAAACTTTTAGGACTTCGTCCATAT :557
TrCHSa3  : GGTGTTGACATGCCTGGTGCTGATTACCAACTCACAAAACTCTTAGGTCTTCGCCCATAT :563
TrCHSa4  : GGTGTTGACATGCCTGGTGCTGATTACCAACTCACAAAACTCTTAGGTCTTCGCCCATAT :548
TrCHSa5  : GGTGTAGACATGCCTGGTGCTGATTACCAACTCACAAAACTCTTGGGACTTCGTCCATAT :549
TrCHSa6  : GGTGTTGACATGCCTGGTGCTGATTACCAACTCACAAAACTCTTAGGTCTTCGCCCATAT :536
TrCHSa7  : ------------------------------------------------------------ : -
TrCHSa8  : GGNGCCN----------------------------------------------------- :483
TrCHSa9  : GGTGTAGACATGCCTGGTGCTGATTACCAACTCACAAAACTCTTAGGACTTCGTCCATAT :542
TrCHSa10 : GGTGTAGACATGCCTGGAGCTGATTACCAACTCACAAAACTCTTAGGTCTTCGCCCATAT :540
TrCHSa11 : GGTGTAGACATGCCTGGAGCTGATTACCAACTCACAAAACTCTTAGGTCTTCGCCCATAT :531
TrCHSa12 : GGTGTTGACATGCCTGGTGCCGATTACCAACTCACAAAACTCTTAGGTCTTCGCCCATAT :530
TrCHSa13 : GGTGTAGACATGCCTGGAGCTGATTACCAACTCACAAAACTCTTAGGTCTTCGCCCATAT :539
TrCHSa14 : GGTGTTGACATGCCTGGTGCTGATTACCAACTCACAAAACTCTTAGGTCTTCGCCCATAT :537
TrCHSa15 : ------------------------------------------------------------ : -
TrCHSa16 : GGTGTANACATGCCTGGTGCTGATTACCNACTNGCAAAACTNTTAGGACTTNGCCCATAT :538
TrCHSa17 : GGTGTTGACATGCCTGGTGCTGATTACCAACTCACAAAACTCTTAGGTCTTCGCCCATAT :537
TrCHSa18 : ------------------------------------------------------------ : -
TrCHSa19 : GGTGTAGACATGCCTGGAGCTGATTACCAACTCACAAAACTCTTAGGTCTTCGCCCATAT :535
TrCHSa20 : GGTGTTGACATGCCTGGTGCTGATTACCAACTCACAAAACTCTTAGGTCTTCGCCCATAT :533
TrCHSa21 : GGTGTAGACATGCCTGGTGCTGATTACCAACTCACAAAACTCTTGGGACTTCGTCCATAT :532
TrCHSa22 : GGTGTTGACATGCCTGGAGCTGATTACCAACTCACAAAACTCTTAGGTCTTCGCCCATAT :529
TrCHSa23 : GGTGTAGACATGCCTGGTGCTGATTACCAGCTCACAAAACTCTTAGGTCTTCGCCCATAT :523
TrCHSa24 : GGTGTAGACATGCCTGGTGCTGATTACCAACTCACAAAACTCTTANGTCTTCGTCCATAC :527
TrCHSa25 : GGTGTTGACATGCCTGGTGCTGATTACCAACTCACAAAACTCTTAGGTCTTCGCCCATAT :527
TrCHSa26 : GGTGTAGACATGCCTGGTGCTGATTACCAACTCACAAAACTCTTAGGTCTTCGTCCATAC :518
TrCHSa27 : GGTGTAGACATGCCTGGTGCTGATTACCAGCTCACAAAACTCTTAGGTCTTCGTCCATAT :515
TrCHSa28 : GGTGTANACATGCCTGGTGCTGATTACCAGCTCACAAAACTCTTAGGTCTTCGTCCATAT :522
TrCHSa29 : GGTGTAGACATGCCTGGAGCTGATTACCAACTCACAAAACTCTTAGGTCTTCGCCCATAT :497
TrCHSa30 : GGTGTTGACATGNCTGGTGCTGATTACCAACTCACAAAACTCTTAGGNCTTCCCCCATAT :481
TrCHSa31 : GGTGTTGACATGNCTGGTGCTGATTACCAACTCACAAAACTCTTAGGNNTTGGCNCATAT :478
TrCHSa32 : GGTGTAGACATGCCTGGAGCTGATTACCAACTCACAAAACTCTTAGGTCTTCGCCCATAT :478
TrCHSa33 : GGTGTAGACATGCCTGGTGCTGATTACCAACTCACAAAACTCTTAGGACTTCGTCCATAT :478
TrCHSa34 : GGTGTAGACATGCCTGGTGCTGATTACCAACTCACAAAACTCTTAGGACTTCGTCCATAT :431
TrCHSa35 : GGTGTTGACATGCCTGGTGCTGATTACCAACTCACAAAACTCTTAGGTCTTCGCCCATAT :419
TrCHSa36 : GGTGTTGACATGCCTGGTGCTGATTACCAACTCACAAAACTCTTAGGTCTTCGCCCATAT :417
TrCHSa37 : GGTGTAGACATGCCTGGAGCTGATTACCAACTCACAAAACTCTTAGGTCTTCGCCCATAT :317
TrCHSa38 : GGTGTAGACATGCCTGGTGCTGATTACCAACTCACAAAACTCTTAGGTCTTCGTCCATAC :267
TrCHSa39 : GGTGTAGACATGCCTGGTGCTGATTACCAGCTCACAAAACTCTTAGGTCTTCGCCCATAT :121
```

FIGURE 15 (cont)

```
              *         680         *         700         *         720
TrCHSa1  : GTG---------------------------------------------------------  :663
TrCHSa2  : GTGAAGAGGTACATGATG-------------------------------------------  :575
TrCHSa3  : GTGAAGAGGTACATGATGTACCAACAAGGGTGCTTTGCAGGTGG-----------------  :607
TrCHSa4  : GTGAAGAGGTACATGATGTACCAACAAGGGTGCTTTGCAGGTGGGACGGTTCTTCGTT--  :606
TrCHSa5  : GTGAAGAGGTTCATGATGTACCAACAAGGTTGTTTTGCAGGAGGC----------------  :594
TrCHSa6  : GTGAAAAGGTATATGATGTACCAACAAGGTTGTTTTGCAGGAGGCACGGTGCTTCGTTTG  :596
TrCHSa7  : ------------------------------------------------------------  :  -
TrCHSa8  : ------------------------------------------------------------  :  -
TrCHSa9  : GTGAAGAGGTACATGATGTACCAACAAGGGTGCTTTGCACGTGG-----------------  :586
TrCHSa10 : GTGAAGAGGTACATGATGTACCAACAAGGGTGCT---------------------------  :574
TrCHSa11 : GTGAAAAGGTATATGATGTACCAACAAGCTTGTTTTGCAGGAGGCACGGTGCTTCGTTTG  :591
TrCHSa12 : GTGAAGAGGTACATGATGTACCAACAAGGGTGCTTTGCAC---------------------  :570
TrCHSa13 : GTGAAGAGGTACATGATGTACCAACAAGGGTGCTTTGCAGGTGGGACGGTTCTTCGTTT-  :598
TrCHSa14 : GTGAAAAGGTATATGATGTACCAACAAGGTTGTTTTGCAGCAGGCACGGTGCTTCGTTTG  :597
TrCHSa15 : ------------------------------------------------------------  :  -
TrCHSa16 : GTGANGAGGCGCCGTGNTGNNCCN-------------------------------------  :561
TrCHSa17 : GTGAAG-------------------------------------------------------  :543
TrCHSa18 : ------------------------------------------------------------  :  -
TrCHSa19 : GTGAAAAGGTATATGATGTACCAACAAGGTTGTTTTGCAGGAGGCACGGTGCTTCGTTTG  :595
TrCHSa20 : GTGAAAAGGTATATGATGTACCAACAAGGTTGTTTTGCAGGAGGCACG-------------  :581
TrCHSa21 : GTGAAGAGATTCATGATGTACCAACAAGCTGCTTTGCAGGTGGGACGGTTCTTCG-----  :588
TrCHSa22 : GTGAAAAGGTATATGATGTACCAACAAGGTTGTTTTGCAGGAGGCACGGTGCTTCGTTTG  :589
TrCHSa23 : GTGAAGAGGTATATGATGTAT----------------------------------------  :544
TrCHSa24 : GTGAAGAGGCACATGATGTACCAACAAG---------------------------------  :555
TrCHSa25 : GTGAAAAGGTATATGATGTACCAACAAGGTTGTTTTGCAGGAG------------------  :570
TrCHSa26 : GTGAAGAGGTACATGATGTACCAACAAG---------------------------------  :546
TrCHSa27 : GTGAAAAGGTATATGATGTACCAACAAGGGTGCTTTGCAGGTGGGACGGTGCTTCGTTTG  :575
TrCHSa28 : GTGAAAAGGCATATGATGTACCAACAAGGGTGCTTTGCAGGTGGGACCGTGCTTCNTTTG  :582
TrCHSa29 : GTGAAAAGGTATATGATGTACCAA-------------------------------------  :521
TrCHSa30 : GTNAAAAGGNATATCATCGCCNTAN------------------------------------  :506
TrCHSa31 : GTGAAGAGGTCTATGATGGACCAACN-----------------------------------  :504
TrCHSa32 : GTGAAAAGGTATATGATGTACCAACAAGGTTGTTTTGCAGGAGGCACGGTGCTTCGTTTG  :538
TrCHSa33 : GTGAAGAGGTACATGATGTACCAACAAGGGTGCTTTGCAGGTGGGCGGTTCTTCGTTTG  :538
TrCHSa34 : GTGAAGAGGTACATGATGTACCAACAAGGGTGCTTTGCAGGTGGGACGGTTCTTCCTTTG  :491
TrCHSa35 : GTGAAGAGGTACATGATGTACCAACAAGGGTGCTTTGCAGGTGGGACGGTTCTTCGTTTG  :479
TrCHSa36 : GTGAAGAGGTACATGATGTACCAACAAGGGTGCTTTGCAGGTGGGACGGTTCTTCGTTTG  :477
TrCHSa37 : GTGAAGAGGTACATGATGTACCAACAACGGTGCTTTGCAGGTGGGACGGTTCTTCGTTTG  :377
TrCHSa38 : GTGAAGAGGTACATGATGTACCAACAAGGGTGCTTTGCAGGTGGGACGGTGCTTCGTTTG  :327
TrCHSa39 : GTGAAGAGGTATATGATGTATCAACAAGGTTGCTTTGCAGGAGGCACGGTGCTTCGTTTG  :181
```

FIGURE 15 (cont)

```
                    *         740         *         760         *         780
TrCHSa1  : ------------------------------------------------------------ : -
TrCHSa2  : ------------------------------------------------------------ : -
TrCHSa3  : ------------------------------------------------------------ : -
TrCHSa4  : ------------------------------------------------------------ : -
TrCHSa5  : ------------------------------------------------------------ : -
TrCHSa6  : GCAAAAGATTTGGCCGAGAACAACAAAGGTGCTCGTGTGCTAGTTGTTTGTTCTGAAGTC : 656
TrCHSa7  : ------------------------------------------------------------ : -
TrCHSa8  : ------------------------------------------------------------ : -
TrCHSa9  : ------------------------------------------------------------ : -
TrCHSa10 : ------------------------------------------------------------ : -
TrCHSa11 : GCAAAAGATTTGG----------------------------------------------- : 604
TrCHSa12 : ------------------------------------------------------------ : -
TrCHSa13 : ------------------------------------------------------------ : -
TrCHSa14 : GCAAAAGATTTG------------------------------------------------ : 609
TrCHSa15 : ------------------------------------------------------------ : -
TrCHSa16 : ------------------------------------------------------------ : -
TrCHSa17 : ------------------------------------------------------------ : -
TrCHSa18 : ------------------------------------------------------------ : -
TrCHSa19 : GCAAAAGATTTG------------------------------------------------ : 607
TrCHSa20 : ------------------------------------------------------------ : -
TrCHSa21 : ------------------------------------------------------------ : -
TrCHSa22 : GCAAAAGATTTGGCCGAGAACAAC------------------------------------ : 613
TrCHSa23 : ------------------------------------------------------------ : -
TrCHSa24 : ------------------------------------------------------------ : -
TrCHSa25 : ------------------------------------------------------------ : -
TrCHSa26 : ------------------------------------------------------------ : -
TrCHSa27 : GCCAAGG----------------------------------------------------- : 582
TrCHSa28 : GCCAANGATTTGGCCNANAACAACAAANGNGCTCGNGNGTTGGNTGCTTGGTCTNAANTC : 642
TrCHSa29 : ------------------------------------------------------------ : -
TrCHSa30 : ------------------------------------------------------------ : -
TrCHSa31 : ------------------------------------------------------------ : -
TrCHSa32 : GCAAAAGATTTGGCCGAGAACAACAAAGGTGCTCGTGTGTTGGTTGTTTGTTCTGAAGTC : 598
TrCHSa33 : GCTAAAGATTTGGCCGAGAACAACAAAGGTGCTCGTGTGTTGGTTGTTTGTTCTGAAGT- : 597
TrCHSa34 : GCTAAAGATTTGGCCGAGAACAACAAAGGTGCTCGTGTGTTGGTTGTTTGTTCTGAAGTA : 551
TrCHSa35 : GCAAACCATTTGGCCGACAACAACAAAGGTGCTCGTGTGTTGGTTGTTTGTTCTGAAGTA : 539
TrCHSa36 : GCCAAGGATTTGGCCGAGAACAACAAAGGTGCTCGTGTGTTGGTTGTTTGTTCTGAAGTA : 537
TrCHSa37 : GCCAAGGATTTGGCCGAGAACAACAAAGGTGCTCGTGTGTTGGTTGTTTGTTCTGAAGTA : 437
TrCHSa38 : GCCAAGGATTTGGCCGAGAACAACAAAGGTGCTCGTGTGTTGGTTGTTTGTTCTGAAGTC : 387
TrCHSa39 : GCTAAAGATTTGGCCGAGAACAACAAAGGTGCTCGTGTGCTAGTTGTTTGTTCTGAAGTA : 241
```

FIGURE 15 (cont)

```
              *        800         *        820         *        840
TrCHSa1  : ------------------------------------------------------------ : -
TrCHSa2  : ------------------------------------------------------------ : -
TrCHSa3  : ------------------------------------------------------------ : -
TrCHSa4  : ------------------------------------------------------------ : -
TrCHSa5  : ------------------------------------------------------------ : -
TrCHSa6  : ACCGCAGTCACATTTCGCGGCCCCAGTGATACTCACTTGGACAGTCTTGNTG-------- :708
TrCHSa7  : ------------------------------------------------------------ : -
TrCHSa8  : ------------------------------------------------------------ : -
TrCHSa9  : ------------------------------------------------------------ : -
TrCHSa10 : ------------------------------------------------------------ : -
TrCHSa11 : ------------------------------------------------------------ : -
TrCHSa12 : ------------------------------------------------------------ : -
TrCHSa13 : ------------------------------------------------------------ : -
TrCHSa14 : ------------------------------------------------------------ : -
TrCHSa15 : ------------------------------------------------------------ : -
TrCHSa16 : ------------------------------------------------------------ : -
TrCHSa17 : ------------------------------------------------------------ : -
TrCHSa18 : ------------------------------------------------------------ : -
TrCHSa19 : ------------------------------------------------------------ : -
TrCHSa20 : ------------------------------------------------------------ : -
TrCHSa21 : ------------------------------------------------------------ : -
TrCHSa22 : ------------------------------------------------------------ : -
TrCHSa23 : ------------------------------------------------------------ : -
TrCHSa24 : ------------------------------------------------------------ : -
TrCHSa25 : ------------------------------------------------------------ : -
TrCHSa26 : ------------------------------------------------------------ : -
TrCHSa27 : ------------------------------------------------------------ : -
TrCHSa28 : ACCGCAN----------------------------------------------------- :649
TrCHSa29 : ------------------------------------------------------------ : -
TrCHSa30 : ------------------------------------------------------------ : -
TrCHSa31 : ------------------------------------------------------------ : -
TrCHSa32 : ACTGCAGTTACATTCCGTGGCCCGAGTGACACTCACTTGGACAGTCTTGTTGGACAAGCA :658
TrCHSa33 : ------------------------------------------------------------ : -
TrCHSa34 : ACTGCAGTCACATTCCGTGGCCCGAGTGACACTCACTTG--------------------- :590
TrCHSa35 : ACCGCAGTCACATTCCGCGGCCCCAGTGACACTCATTTGGACAGCCTTGTTGGACAAGCA :599
TrCHSa36 : ACCGCAGTCACATTCCGCGGCCCCAGTGACACTCATTTGGACAGCCTTGTTGGACAAGCA :597
TrCHSa37 : ACCGCAGTCACATTCCGCGGCCCCAGTGACACTCATTTGGACAGTCTTGTTGGACAAGCA :497
TrCHSa38 : ACCGCAGTCACATTCCGTGGCCCTAGTGACACTCATTTGGACAGTCTTGTTGGACAAGCA :447
TrCHSa39 : ACAGCAGTCACATTCCGCGGTCCAAGTGACACTCACTTGGACAGTCTTGTTGGACAAGCA :301
```

FIGURE 15 (cont)

```
                    *         860         *         880         *         900
TrCHSa1  : ------------------------------------------------------------ : -
TrCHSa2  : ------------------------------------------------------------ : -
TrCHSa3  : ------------------------------------------------------------ : -
TrCHSa4  : ------------------------------------------------------------ : -
TrCHSa5  : ------------------------------------------------------------ : -
TrCHSa6  : ------------------------------------------------------------ : -
TrCHSa7  : ------------------------------------------------------------ : -
TrCHSa8  : ------------------------------------------------------------ : -
TrCHSa9  : ------------------------------------------------------------ : -
TrCHSa10 : ------------------------------------------------------------ : -
TrCHSa11 : ------------------------------------------------------------ : -
TrCHSa12 : ------------------------------------------------------------ : -
TrCHSa13 : ------------------------------------------------------------ : -
TrCHSa14 : ------------------------------------------------------------ : -
TrCHSa15 : ------------------------------------------------------------ : -
TrCHSa16 : ------------------------------------------------------------ : -
TrCHSa17 : ------------------------------------------------------------ : -
TrCHSa18 : ------------------------------------------------------------ : -
TrCHSa19 : ------------------------------------------------------------ : -
TrCHSa20 : ------------------------------------------------------------ : -
TrCHSa21 : ------------------------------------------------------------ : -
TrCHSa22 : ------------------------------------------------------------ : -
TrCHSa23 : ------------------------------------------------------------ : -
TrCHSa24 : ------------------------------------------------------------ : -
TrCHSa25 : ------------------------------------------------------------ : -
TrCHSa26 : ------------------------------------------------------------ : -
TrCHSa27 : ------------------------------------------------------------ : -
TrCHSa28 : ------------------------------------------------------------ : -
TrCHSa29 : ------------------------------------------------------------ : -
TrCHSa30 : ------------------------------------------------------------ : -
TrCHSa31 : ------------------------------------------------------------ : -
TrCHSa32 : TTGTTTGCAGATGGAGCAGCTGCACTTATCGTTGGTTCTGATCCAGTACCAGAAATTGAG :718
TrCHSa33 : ------------------------------------------------------------ : -
TrCHSa34 : ------------------------------------------------------------ : -
TrCHSa35 : CTATTTGGAGATGGAGCTG----------------------------------------- :618
TrCHSa36 : CTATTTGGAGATGGAGCTGCTG-------------------------------------- :619
TrCHSa37 : CTATTCGGAGATGGAGCTGCTGCACTCATTGTTGGCTCAGACCCAGTACCAGAAATTGAG :557
TrCHSa38 : CTATTTGGAGATGGAGCTGCTGCCCTCATTGTTGGTTCTGACCCAGTACCAGAAATTGAG :507
TrCHSa39 : CTATTCGGAGATGGAGCTGCTGCTCTCATTGTTGGCTCAGACCCTGTACCAGAAATCGAG :361
```

FIGURE 15 (cont)

```
                   *         920         *         940         *         960
TrCHSa1  : ------------------------------------------------------------- : -
TrCHSa2  : ------------------------------------------------------------- : -
TrCHSa3  : ------------------------------------------------------------- : -
TrCHSa4  : ------------------------------------------------------------- : -
TrCHSa5  : ------------------------------------------------------------- : -
TrCHSa6  : ------------------------------------------------------------- : -
TrCHSa7  : ------------------------------------------------------------- : -
TrCHSa8  : ------------------------------------------------------------- : -
TrCHSa9  : ------------------------------------------------------------- : -
TrCHSa10 : ------------------------------------------------------------- : -
TrCHSa11 : ------------------------------------------------------------- : -
TrCHSa12 : ------------------------------------------------------------- : -
TrCHSa13 : ------------------------------------------------------------- : -
TrCHSa14 : ------------------------------------------------------------- : -
TrCHSa15 : ------------------------------------------------------------- : -
TrCHSa16 : ------------------------------------------------------------- : -
TrCHSa17 : ------------------------------------------------------------- : -
TrCHSa18 : ------------------------------------------------------------- : -
TrCHSa19 : ------------------------------------------------------------- : -
TrCHSa20 : ------------------------------------------------------------- : -
TrCHSa21 : ------------------------------------------------------------- : -
TrCHSa22 : ------------------------------------------------------------- : -
TrCHSa23 : ------------------------------------------------------------- : -
TrCHSa24 : ------------------------------------------------------------- : -
TrCHSa25 : ------------------------------------------------------------- : -
TrCHSa26 : ------------------------------------------------------------- : -
TrCHSa27 : ------------------------------------------------------------- : -
TrCHSa28 : ------------------------------------------------------------- : -
TrCHSa29 : ------------------------------------------------------------- : -
TrCHSa30 : ------------------------------------------------------------- : -
TrCHSa31 : ------------------------------------------------------------- : -
TrCHSa32 : AAACCAATATTTGAGATGGTTTGGACTGCACAAACAATTGCTCCAGACAGTGAAGGTGCC :778
TrCHSa33 : ------------------------------------------------------------- : -
TrCHSa34 : ------------------------------------------------------------- : -
TrCHSa35 : ------------------------------------------------------------- : -
TrCHSa36 : ------------------------------------------------------------- : -
TrCHSa37 : AN----------------------------------------------------------- :559
TrCHSa38 : AAGCCAATATTTGAGATGGTATGGACCGCACAGACAATTGCTCCAG--------------- :553
TrCHSa39 : AAACCTATATTTGAGATGGTATGGACCGCACAGACAATTGCTCCGGACAGTGAAGGTGCC :421
```

FIGURE 15 (cont)

```
                    *         980         *        1000         *        1020
TrCHSa1  : ------------------------------------------------------------ : -
TrCHSa2  : ------------------------------------------------------------ : -
TrCHSa3  : ------------------------------------------------------------ : -
TrCHSa4  : ------------------------------------------------------------ : -
TrCHSa5  : ------------------------------------------------------------ : -
TrCHSa6  : ------------------------------------------------------------ : -
TrCHSa7  : ------------------------------------------------------------ : -
TrCHSa8  : ------------------------------------------------------------ : -
TrCHSa9  : ------------------------------------------------------------ : -
TrCHSa10 : ------------------------------------------------------------ : -
TrCHSa11 : ------------------------------------------------------------ : -
TrCHSa12 : ------------------------------------------------------------ : -
TrCHSa13 : ------------------------------------------------------------ : -
TrCHSa14 : ------------------------------------------------------------ : -
TrCHSa15 : ------------------------------------------------------------ : -
TrCHSa16 : ------------------------------------------------------------ : -
TrCHSa17 : ------------------------------------------------------------ : -
TrCHSa18 : ------------------------------------------------------------ : -
TrCHSa19 : ------------------------------------------------------------ : -
TrCHSa20 : ------------------------------------------------------------ : -
TrCHSa21 : ------------------------------------------------------------ : -
TrCHSa22 : ------------------------------------------------------------ : -
TrCHSa23 : ------------------------------------------------------------ : -
TrCHSa24 : ------------------------------------------------------------ : -
TrCHSa25 : ------------------------------------------------------------ : -
TrCHSa26 : ------------------------------------------------------------ : -
TrCHSa27 : ------------------------------------------------------------ : -
TrCHSa28 : ------------------------------------------------------------ : -
TrCHSa29 : ------------------------------------------------------------ : -
TrCHSa30 : ------------------------------------------------------------ : -
TrCHSa31 : ------------------------------------------------------------ : -
TrCHSa32 : ATTG-------------------------------------------------------- :782
TrCHSa33 : ------------------------------------------------------------ : -
TrCHSa34 : ------------------------------------------------------------ : -
TrCHSa35 : ------------------------------------------------------------ : -
TrCHSa36 : ------------------------------------------------------------ : -
TrCHSa37 : ------------------------------------------------------------ : -
TrCHSa38 : ------------------------------------------------------------ : -
TrCHSa39 : ATTGATGGTCACCTTCGTGAACCTGGACTAACATTTCATCTTCTTAAAGATGTTCCTGGG :481
```

FIGURE 15 (cont)

```
              *        1040         *        1060         *        1080
TrCHSa1  : ----------------------------------------------------------------- : -
TrCHSa2  : ----------------------------------------------------------------- : -
TrCHSa3  : ----------------------------------------------------------------- : -
TrCHSa4  : ----------------------------------------------------------------- : -
TrCHSa5  : ----------------------------------------------------------------- : -
TrCHSa6  : ----------------------------------------------------------------- : -
TrCHSa7  : ----------------------------------------------------------------- : -
TrCHSa8  : ----------------------------------------------------------------- : -
TrCHSa9  : ----------------------------------------------------------------- : -
TrCHSa10 : ----------------------------------------------------------------- : -
TrCHSa11 : ----------------------------------------------------------------- : -
TrCHSa12 : ----------------------------------------------------------------- : -
TrCHSa13 : ----------------------------------------------------------------- : -
TrCHSa14 : ----------------------------------------------------------------- : -
TrCHSa15 : ----------------------------------------------------------------- : -
TrCHSa16 : ----------------------------------------------------------------- : -
TrCHSa17 : ----------------------------------------------------------------- : -
TrCHSa18 : ----------------------------------------------------------------- : -
TrCHSa19 : ----------------------------------------------------------------- : -
TrCHSa20 : ----------------------------------------------------------------- : -
TrCHSa21 : ----------------------------------------------------------------- : -
TrCHSa22 : ----------------------------------------------------------------- : -
TrCHSa23 : ----------------------------------------------------------------- : -
TrCHSa24 : ----------------------------------------------------------------- : -
TrCHSa25 : ----------------------------------------------------------------- : -
TrCHSa26 : ----------------------------------------------------------------- : -
TrCHSa27 : ----------------------------------------------------------------- : -
TrCHSa28 : ----------------------------------------------------------------- : -
TrCHSa29 : ----------------------------------------------------------------- : -
TrCHSa30 : ----------------------------------------------------------------- : -
TrCHSa31 : ----------------------------------------------------------------- : -
TrCHSa32 : ----------------------------------------------------------------- : -
TrCHSa33 : ----------------------------------------------------------------- : -
TrCHSa34 : ----------------------------------------------------------------- : -
TrCHSa35 : ----------------------------------------------------------------- : -
TrCHSa36 : ----------------------------------------------------------------- : -
TrCHSa37 : ----------------------------------------------------------------- : -
TrCHSa38 : ----------------------------------------------------------------- : -
TrCHSa39 : ATTGTATCAAAGAACATTAATAAAGCATTGGTCGAGGCTTTCCAACCATTAGGAATTTCT :541
```

FIGURE 15 (cont)

```
              *         1100         *        1120         *
TrCHSa1  : ---------------------------------------------------- : -
TrCHSa2  : ---------------------------------------------------- : -
TrCHSa3  : ---------------------------------------------------- : -
TrCHSa4  : ---------------------------------------------------- : -
TrCHSa5  : ---------------------------------------------------- : -
TrCHSa6  : ---------------------------------------------------- : -
TrCHSa7  : ---------------------------------------------------- : -
TrCHSa8  : ---------------------------------------------------- : -
TrCHSa9  : ---------------------------------------------------- : -
TrCHSa10 : ---------------------------------------------------- : -
TrCHSa11 : ---------------------------------------------------- : -
TrCHSa12 : ---------------------------------------------------- : -
TrCHSa13 : ---------------------------------------------------- : -
TrCHSa14 : ---------------------------------------------------- : -
TrCHSa15 : ---------------------------------------------------- : -
TrCHSa16 : ---------------------------------------------------- : -
TrCHSa17 : ---------------------------------------------------- : -
TrCHSa18 : ---------------------------------------------------- : -
TrCHSa19 : ---------------------------------------------------- : -
TrCHSa20 : ---------------------------------------------------- : -
TrCHSa21 : ---------------------------------------------------- : -
TrCHSa22 : ---------------------------------------------------- : -
TrCHSa23 : ---------------------------------------------------- : -
TrCHSa24 : ---------------------------------------------------- : -
TrCHSa25 : ---------------------------------------------------- : -
TrCHSa26 : ---------------------------------------------------- : -
TrCHSa27 : ---------------------------------------------------- : -
TrCHSa28 : ---------------------------------------------------- : -
TrCHSa29 : ---------------------------------------------------- : -
TrCHSa30 : ---------------------------------------------------- : -
TrCHSa31 : ---------------------------------------------------- : -
TrCHSa32 : ---------------------------------------------------- : -
TrCHSa33 : ---------------------------------------------------- : -
TrCHSa34 : ---------------------------------------------------- : -
TrCHSa35 : ---------------------------------------------------- : -
TrCHSa36 : ---------------------------------------------------- : -
TrCHSa37 : ---------------------------------------------------- : -
TrCHSa38 : ---------------------------------------------------- : -
TrCHSa39 : GATTACAACTCAATCTTTTGGATTGCACACCCGGGTGGACCTGCAATTCT   : 591
```

FIGURE 15 (cont)

```
                  *        20         *        40         *        60
TrCHSb : TCTTCGNCNAGCTGGACNAACATTTNTGCTTCTTAAAGATGTTCCTGAGATTGTCTCAAA :  60

*        80         *       100         *       120
TrCHSb : GAACATTGATAAGGCATTGGTTGAGGCATTCCAACCATTAAACATCTCTGATTACAATTC : 120

*       140         *       160         *       180
TrCHSb : AATCTTTTGGATTGCTCATCCAGGTGGTCCTGCAATTCTAGACCAAGTTGAGATAAAGTT : 180

*       200         *       220         *       240
TrCHSb : GGGCTTAAAACCTGAAAAAATGAAGGCCACCAGAGATGTACTTAGTGAATATGGTAACAT : 240

*       260         *       280         *       300
TrCHSb : GTCAAGTGCATGTGTATTGTTCATCTTAGATGAGATGCAAAAGAAATCGGCTGAAAATGG : 300

*       320         *       340         *       360
TrCHSb : ACTGAAAACCACAGGAGAAGGACTTGACTGGGGTGTGTTGTTTGGATTTGGACCAGGACT : 360

*       380         *       400         *       420
TrCHSb : TACCATTGAAACTGTTGTTCTACATAGTGTGGCTATATGAGAATGCGAGACTTGATTGTT : 420

*       440         *       460         *       480
TrCHSb : TTGTATTGTATTGTATTGTATTGTATTACTTTTAATCTTGCTTGAATTTCCATTTAACAA : 480

*       500         *       520         *       540
TrCHSb : TAAATATGGAGTTCAATAAGTACCATCAGTGTTAAAATAATATATCGTTAATAGCTATTA : 540

*       560         *       580         *       600
TrCHSb : TTTTAGTGTCTGTTTCTTTTTACTAAACTATATTTTATTTTAGTATTTGCTATTGATTTG : 600

*       620         *
TrCHSb : AAATAAATATTGTCCTCTTAACTGAAAAAAAAAA : 634
```

FIGURE 16

```
              *         20         *         40         *         60
TrCHSb : LRXAGXTFXLLKDVPEIVSKNIDKALVEAFQPLNISDYNSIFWIAHPGGPAILDQVEIKL :  60

*         80         *        100         *        120
TrCHSb : GLKPEKMKATRDVLSEYGNMSSACVLFILDEMQKKSAENGLKTTGEGLDWGVLFGFGPGL : 120

*
TrCHSb : TIETVVLHSVAI : 132
```

FIGURE 17

```
              *         20         *         40         *         60
TrCHSb1:  TCTTCGNCNAGCTGGACNAACATTTNTGCTTCTTAAAGATGTTCCTGAGATTGTCTCAAA  :  60
TrCHSb2:  ------------------------------------------------------------  :   -
TrCHSb3:  ------------------------------------------------------------  :   -

*         80         *        100         *        120
TrCHSb1:  GAACATTGATAAGGCATTGGTTGAGGCATTCCAACCATTAAACATCTCTGATTACAATTC  : 120
TrCHSb2:  ------------------------------------------------------------  :   -
TrCHSb3:  ------------------------------------------------------------  :   -

*        140         *        160         *        180
TrCHSb1:  AATCTTTTGGATTGCTCATCCAGGTGGTCCTGCAATTCTAGACCAAGTTGAGATAAAGTT  : 180
TrCHSb2:  ------------------------------------------------------------  :   -
TrCHSb3:  ------------------------------------------------------------  :   -

*        200         *        220         *        240
TrCHSb1:  GGGCTTAAAACCTGAAAAAATGAAGGCCACCAGAGATGTACTTAGTGAATATGGTAACAT  : 240
TrCHSb2:  ------------------------------------------------------------  :   -
TrCHSb3:  ------------------------------------------------------------  :   -

*        260         *        280         *        300
TrCHSb1:  GTCAAGTGCATGTGTATTGTTCATCTTAGATGAGATGAGAAAGAAATCGGCTGAAAATGG  : 300
TrCHSb2:  -----------------------------GAGATGCACAAGAAATCGGCTNAAAATGG   :  29
TrCHSb3:  -----------------------------GAGATGCCAAAGAAATCGGCTCAAAATGG   :  29

*        320         *        340         *        360
TrCHSb1:  ACTAAAAACCACAGGAGAAGGACTTGACTGGGGTGTGTTGTTTGGATTTGGGCCGGGACT  : 360
TrCHSb2:  ACTGAAAACCACAGGAGAAGGACTTGACTGGGGTGTGTTGTTTGGATTTGGACCAGGACT  :  89
TrCHSb3:  ACTGAAAACCACAGGAGAAGGACTTGACTGGGGTGTGTTGTTTGGATTTGGACCAGGACT  :  89

*        380         *        400         *        420
TrCHSb1:  TACCATTGAAACTGTTGTTCTACATAGTGTGGCTATATGAGAATGAGAGACTTGATTTGT  : 420
TrCHSb2:  TACCATTGAAACTGTTGTTCTACATAGTGTGGCTATATGAGAATGCCAGACTTGATTGTT  : 149
TrCHSb3:  TACCATTGAAACTGTTGTTCTACATAGTGTGGCTATATGAGAATGCCAGACTTGATTGTT  : 149

*        440         *        460         *        480
TrCHSb1:  T---T---T---T----ATTGAATTGTATTACTTTTAATCTTGCNTGAAGTTCCATTTAANAA  : 470
TrCHSb2:  TTGTATTGTATTGTATTGTATTACTTTTAATCTTGCTTGAATTTCCATTTAACAA  : 209
TrCHSb3:  TTGTATTGTATTGTATTGTATTACTTTTAATCTTGCTTGAATTTCCATTTAACAA  : 209

*        500         *        520         *        540
TrCHSb1:  TAAGTATGGNCNTCANTNNGN---------------------------------------  : 491
TrCHSb2:  TAAATATGGAGTTCAATAAGTACCATCAGTGTTAAAATAATATATCGTTAATAGCTATTA  : 269
TrCHSb3:  TAAATATGGAGTTCAATAAGTACCATCAGTGTTAAAATAATATATCGTTAATAGCTATTA  : 269

*        560         *        580         *        600
TrCHSb1:  ------------------------------------------------------------  :   -
TrCHSb2:  TTTTAGTGTCTGTTTCTTTTTACTAAACTATATTTTATTTTAGTATTTGCTATTGATTTG  : 329
TrCHSb3:  TTTTAGTGTCTGTTTCTTTTTACTAAACTATATTTTATTTTAGTATTTGCTATTGATTTG  : 329

*        620         *
TrCHSb1 :  ----------------------------   :   -
TrCHSb2 :  AAATAAATATTGTCCTCTTAACTGAAAAAAAAAA  : 363
TrCHSb3 :  AAATAAATATTGTCCTCTTAACTGAAAAAAAAAA  : 363
```

FIGURE 18

```
                     *        20         *        40         *        60
TrCHSc : GNTTCAATCTGTTGTGCATAAAATTNCTTTGCNATAGAAAACCATACACATTTGATCTTG :  60

*        80         *       100         *       120
TrCHSc : CAAAGAAGAAATATGGGAGACGAAGGTATAGTGAGAGGTGTCACAAAGCAGACAACCCCT : 120

*       140         *       160         *       180
TrCHSc : GGGAAGGCTACTATATTGGCTCTTGGCAAGGCATTCCCTCACCAACTTGTGATGCAAGAG : 180

*       200         *       220         *       240
TrCHSc : TATTTAGTTGATGGTTATTTTAGGGACACTAATTGTGACAATCCTGAACTTAAGCAGAAA : 240

*       260         *       280         *       300
TrCHSc : CTTGCTAGACTTTGTAAGACAACCACGGTAAAAACAAGGTATGTTGTTATGAATGAGGAG : 300

*       320         *       340         *       360
TrCHSc : ATACTAAAGAAATATCCAGAACTTGTTGTCGAAGGCGCCTCAACTGTAAAACAACGTTTA : 360

*       380         *       400         *       420
TrCHSc : GAGATATGTAATGAGGCAGTAACACAAATGGCAATTGAAGCTTCCCAAGTTTGCCTAAAG : 420

*       440         *       460         *       480
TrCHSc : AATTGGGGTAGATCCTTATCGGACATAACTCATGTGGTTTATGTTTCATCTAGTGAAGCT : 480

*       500         *       520         *       540
TrCHSc : AGATTACCCGGTGGTGACCTATACTTGTCAAAAGGACTAGGACTAAACCCTAAAATTCAA : 540

*       560         *       580         *       600
TrCHSc : AGAACCATGCTCTATTTCTCTGGATGCTCGGGAGGCGTAGCCGGCCTTCGCGTTGCGAAA : 600

*       620         *       640         *       660
TrCHSc : GACATAGCTGAGAACAACCCTGGAAGTAGAGTTTTGCTTGCTACTTCTGAAACTACAATT : 660

*       680         *       700         *       720
TrCHSc : ATTGGATTCAAGCCACCAAGTGTTGATAGACCTTATGATCTTGTTGGTGTGGCACTCTTT : 720

*       740         *       760         *       780
TrCHSc : GGAGATGGTGCTGGTGCTATGATAATTGGCTCAGACCCAATACTTGAAACTGAGACTCCA : 780

*       800         *       820         *       840
TrCHSc : TTGTTTGAGCTTCATACTTCAGCTCAGGAGTTTATACCAGACACAGAGAAGAAAATAGAT : 840

*       860         *       880         *
TrCHSc : GGGCGGCTGACGGAGGAGGGCATAAGTTTCACGCTAGCGAGGGAACTGCCGCAGATA : 897
```

FIGURE 19

```
            *         20         *         40         *         60
TrCHSc : MGDEGIVRGVTKQTTPGKATILALGKAFPHQLVMQEYLVDGYFRDTNCDNPELKQKLARL :  60

*         80         *        100         *        120
TrCHSc : CKTTTVKTRYVVMNEEILKKYPELVVEGASTVKQRLEICNEAVTQMAIEASQVCLKNWGR : 120

*        140         *        160         *        180
TrCHSc : SLSDITHVVYVSSSEARLPGGDLYLSKGLGLNPKIQRTMLYFSGCSGGVAGLRVAKDIAE : 180

*        200         *        220         *        240
TrCHSc : NNPGSRVLLATSETTIIGFKPPSVDRPYDLVGVALFGDGAGAMIIGSDPILETETPLFEL : 240

*        260         *
TrCHSc : HTSAQEFIPDTEKKIDGRLTEEGISFTLARELPQI : 275
```

FIGURE 20

```
             *        20         *        40         *        60
TrCHSc1 : GNTTCAATCTGTTGTGCATAAAATTNCTTTGCNATAGAAAACNCTACACATTTGATCTTG : 60
TrCHSc2 : ---TCAATCTGTTGNGCATTTTNTTNCTTTGCNATAGAAAACCATACACATTTGATCTTG : 57
TrCHSc3 : ------TCTGTTGTGNTAACATTNCTTTCCNTTAGAAAACTATACACATTTGATCTTG : 53
TrCHSc4 : ------TCTGTTGTGCNTNAAATTACTTTGNNNTAGAAAACNCTACACATTTGATCTTG : 53
TrCHSc5 : --------------------TTAACATTTTTTTATTGTAGAAAATATACATTTGATCTAG : 40
TrCHSc6 : ------------------------------GCANTAGAAACCCTACACATTTGATCTTG : 30
TrCHSc7 : ------------------------------------------------------------ : -

*        80         *       100         *       120
TrCHSc1 : CAAAGAAGAAATATGGGAGACGAAGGTATAGTGAGAGGTGTCACAAAGCAGACAACCCCT : 120
TrCHSc2 : CTTAGAAGAAATATGGGAGACGAAGGTATAGTGAGAGGTGTCACAAAGCAGACAACCCCT : 117
TrCHSc3 : CAAAGAAGAAATATGGGAGACGAAGGTATAGTGAGAGGTGTCACAAAGCAGACAACCCCT : 113
TrCHSc4 : CAAAGAAGAAATATGGGAGACGAAGGTATAGTGAGAGGTGTCACAAAGCAGACAACCCCT : 113
TrCHSc5 : CAAAGAAGAAATATGGGAGACGAAGGTATAGTGAGAGGTGTCACAAGGCAGCCAACCCCT : 100
TrCHSc6 : CAAAGAAGAAATATGGGAGACGAATGTATAGTGAGAGGTGTCACAAAGCAGACAACCCCT : 90
TrCHSc7 : ------------------------------------------------------------ : -

*       140         *       160         *       180
TrCHSc1 : GGGAAGGCTACTATATTGGCTCTTGGCAAGGCATTCCCTCACCAACTTGTGATGCAAGAG : 180
TrCHSc2 : GGGAAGGCTACTATATTGGCTCTTGGCAAGGCATTCCCTCACCAACTTGTGATGCAAGAG : 177
TrCHSc3 : GGGAAGGCTACTATATTGGCTCTTGGCAAGGCATTCCCTCACCAACTTGTGATGCAAGAG : 173
TrCHSc4 : GGGAAGGCTACTATATTGGCTCTTGGCAAGGCATTCCCTCACCAACTTGTGATGCAAGAG : 173
TrCHSc5 : GGGAAGGCTACTATATTGGCTCTTGGCAAGGCATTCCCTCACCAACTTGTGATGCAAGAG : 160
TrCHSc6 : GGGAAGGCTACTATATTGGCTCTTGGCAAGGCATTCCCTCACCAACTTGTGATGCAAGAG : 150
TrCHSc7 : ------------------------------------------------------------ : -

*       200         *       220         *       240
TrCHSc1 : TCTTTAGTTGATGGTTATTTTAGGGACACTAATTGTGACAATCCTGAACTTAAGCAGAAA : 240
TrCHSc2 : TCTTTAGTTGATGGTTATTTTAGGGACACTAATTGTGACAATCCTGAACTTAAGCAGAAA : 237
TrCHSc3 : TATTTAGTTGATGGTTATTTTAGGGACACTAATTGTGACAATCCTGAACTTAAGCAGAAA : 233
TrCHSc4 : TCTTTAGTTGATGGTTATTTTAGGGACACTAATTGTGACAATCCTGAACTTAAGCAGAAA : 233
TrCHSc5 : TATTTAGTTGATGGTTATTTTAGGGACACTAATTGTGACAATCCTAGCTTAAGCAGAAA : 220
TrCHSc6 : TATTTAGTTGATGGTTATTTTAGGGACACTAATTGTGACAATCCTGACCTTAAGCAGAAA : 210
TrCHSc7 : ------------------------------------------------------------ : -

*       260         *       280         *       300
TrCHSc1 : CTTGCTAGACTTTGTAAGACAACCACGGTAAAAACAAGGTATGTTGTTATGAATGAGGAG : 300
TrCHSc2 : CTTGCTAGACTTTGTAAGACAACCACGGTAAAAACAAGGTATGTTGTTATGAATGAGGAG : 297
TrCHSc3 : CTTGCTAGACTTTGTAAGACAACCACGGTAAAAACAAGGTATGTTGTTATGAATGAGGAG : 293
TrCHSc4 : CTTGCTAGACTTTGTAAGACAACCACGGTAAAAACAAGGTATGTTGTTATGAATGAGGAG : 293
TrCHSc5 : CTTGCTAGACTTTGCAAGACAACCACAGTAAAAACAAGGTATGTTGTTATGAATGAACAG : 280
TrCHSc6 : CTTGCTAGACTTTGTAAGACAACCACGGTAAAAACAAGGTATGTTGTTATGAATGAGGAG : 270
TrCHSc7 : ------------------------------------------------------------ : -

*       320         *       340         *       360
TrCHSc1 : ATACTAAAGAAATATCCAGAACTTGTTGTCGAAGGCGCCTCAACTGTAAAACAACGTTTA : 360
TrCHSc2 : ATACTAAAGAAATATCCAGAACTTGTTGTCGAAGGCGCCTCAACTGTAAAACAACGTTTA : 357
TrCHSc3 : ATACTAAAGAAATATCCAGAACTTGTTGTCGAAGGCGCCTCAACTGTAAAACAACGTTTA : 353
TrCHSc4 : ATACTAAAGAAATATCCAGAACTTGTTGTCGAAGGCGCCTCAACTGTAAAACAACGTTTA : 353
TrCHSc5 : ATACTAAAGAAATATCCAGAACTTAGTATCGGAGGCACCTCGACGGTAAAACAACATTTA : 340
TrCHSc6 : ATACTAAAGAAATATCCAGAACTTGTTGTCGAAGGCGCCTCAACTGTAAAACAACGTTTA : 330
TrCHSc7 : -----------NTCCNGAACTTACTGTGGAAGGCGCCTCGACTGTAAAACNACGTTTA : 47
```

FIGURE 21

```
              *         380         *         400         *         420
TrCHSc1 : GAGATATGTAATGAGGCAGTAACACAAATGGCAATTGAAGCTTCCCAAGTTTGCCTAAAG : 420
TrCHSc2 : GAGATATGTAATGAGGCAGTAACACAAATGGCAATTGAAGCTTCCCAAGTTTGCCTAAAG : 417
TrCHSc3 : GAGATATGTAATGAGGCAGTAACACAAATGGCAATTGAAGCTTCCCAAGTTTGCCTAAAG : 413
TrCHSc4 : GAGATATGTAATGAGGCAGTAACACAAATGGCAATTGAAGCTTCCCAAGTTTGCCTAAAG : 413
TrCHSc5 : GAGATATGTAATGAGGCAGTAACACAAATGGCAATTGAAGCTTCCCAAGTTTGCCTAAAG : 400
TrCHSc6 : GAGATATGTAATGAGGCAGTAACACAAATGGCAATTGAAGCTTCCCAAGTTTGCCTAAAG : 390
TrCHSc7 : GAGATATGTAATGAGGCAGTAACACAAATGGCAATTGAAGCTTCCCAAGTTTGCCTAAAG : 107

*         440         *         460         *         480
TrCHSc1 : AATTGGGGTAGATCCTTATCGGACATAACTCATGTGGTTTATGTTTCATCTAGTGAAGCT : 480
TrCHSc2 : AATTGGGGTAGATCCTTATCGGACATAACTCATGTGGTTTATGTTTCATCTAGTGAAGCT : 477
TrCHSc3 : AATTGGGGTAGATCCTTATCGGACATAACTCATGTGGTTTATGTTTCATCTAGTGAAGCT : 473
TrCHSc4 : AATTGGGGTAGATCCTTATCGGACATAACTCATGTGGTTTATGTTTCATCTAGTGAAGCT : 473
TrCHSc5 : AATTGGGGTAGACCATATCAGACATAACTCATGTGGTTTATGTTTCATCTAGTGAAGCT : 460
TrCHSc6 : AATTGGGGTAGATCCTTATCGGACATAACTCATGTGGTTTATGTTTCATCTAGTGAAGCT : 450
TrCHSc7 : AATTCGCGTACAGCCTTATCACACATAACTCATGTGGTTTATGTTTCCTCTAGTGAAGCT : 167

*         500         *         520         *         540
TrCHSc1 : AGATTACCCGGTGGTGACCTATACTTGTCAAAAGGACTAGGACTAAACCCTAAAATTCAA : 540
TrCHSc2 : AGATTACCCGGTGGTGACCTATACTTGTCAAAAGGACTAGGACTAAACCCTAAAATTCAA : 537
TrCHSc3 : AGATTACCCGGTGGTGACCTATACTTGTCAAAAGGACTAGGACTAAACCCTAAAATTCAA : 533
TrCHSc4 : AGATTACCCGGTGGTGACCTATACTTGTCAAAAGGACTAGGACTAAACCCTAAAATTCAA : 533
TrCHSc5 : AGATTACCTGGTGGTGACCTATACTTGTCAAAAGGACTAGGACTAAACCCTAAAATTCAA : 520
TrCHSc6 : AGATTACCCGGTGGTGACCTATACTTGTCAAAAGGACTAGGACTAAACCCTAAAATTCAA : 510
TrCHSc7 : AGATTACCCGGTGGTGACCTATATTGTCAAAAGGACTAGGACTAAATCCTAAAATTCAA : 227

*         560         *         580         *         600
TrCHSc1 : AGAACCATGCTCTATTTCTCTGGATGCTCGGGAGGCG----------------------- : 577
TrCHSc2 : AGAACCATGCTCTATTTCTCTGGATGCTCGGGAGGCGTAGCCGGCCTTCGCGTTGCGAAA : 597
TrCHSc3 : AGAACCATGCTCTATTTCTCTGGATGCTCGGGAGGCGTAGCCGGCCTT------------ : 581
TrCHSc4 : AGAACCATGCTCTATTTCTCTGGATGCTCGGGAGGCGTAGCCGGCCTTCGCGTTG----- : 588
TrCHSc5 : AGAACCATGCTCTATTTCTCGGGATGCTCGGGAGGCGTAGCCG----------------- : 563
TrCHSc6 : AGAACCATGCTCTATTTCTCTGGATGCTCGGGAGGCGTAGCCGGCCTTCGCGTTGCGAAA : 570
TrCHSc7 : AGAACCATGCTCTATTTCTCTGGATGCTCAGGAGGCGTAGCCGGCCTTCGCGTTGCCAAA : 287

*         620         *         640         *         660
TrCHSc1 : ------------------------------------------------------------ : -
TrCHSc2 : GA---------------------------------------------------------- : 599
TrCHSc3 : ------------------------------------------------------------ : -
TrCHSc4 : ------------------------------------------------------------ : -
TrCHSc5 : ------------------------------------------------------------ : -
TrCHSc6 : GACATAGCTGAGAACAACCCTGGAAGTAGAGTT--------------------------- : 603
TrCHSc7 : GACATAGCTGAGAACAACCCTGGAAGTAGAGTTTTGCTTGCTACTTCTGAAACTACAATT : 347

*         680         *         700         *         720
TrCHSc1 : ------------------------------------------------------------ : -
TrCHSc2 : ------------------------------------------------------------ : -
TrCHSc3 : ------------------------------------------------------------ : -
TrCHSc4 : ------------------------------------------------------------ : -
TrCHSc5 : ------------------------------------------------------------ : -
TrCHSc6 : ------------------------------------------------------------ : -
TrCHSc7 : ATTGGATTCAAGCCACCAAGTGTTGATAGACCTTATGATCTTGTTGGTGTGGCACTCTTT : 407
```

FIGURE 21 (cont)

```
             *        740         *        760         *        780
TrCHSc1: ---------------------------------------------------------- :   -
TrCHSc2: ---------------------------------------------------------- :   -
TrCHSc3: ---------------------------------------------------------- :   -
TrCHSc4: ---------------------------------------------------------- :   -
TrCHSc5: ---------------------------------------------------------- :   -
TrCHSc6: ---------------------------------------------------------- :   -
TrCHSc7: GGAGATGGTGCTGGTGCTATGATAATTGGCTCAGACCCAATACTTGAAACTGAGACTCCA : 467

*        800         *        820         *        840
TrCHSc1: ---------------------------------------------------------- :   -
TrCHSc2: ---------------------------------------------------------- :   -
TrCHSc3: ---------------------------------------------------------- :   -
TrCHSc4: ---------------------------------------------------------- :   -
TrCHSc5: ---------------------------------------------------------- :   -
TrCHSc6: ---------------------------------------------------------- :   -
TrCHSc7: TTGTTTGAGCTTCATACTTCAGCTCAGGAGTTTATACCAGACACAGAGAAGAAAATAGAT : 527

*        860         *        880         *
TrCHSc1: ------------------------------------------------------ :   -
TrCHSc2: ------------------------------------------------------ :   -
TrCHSc3: ------------------------------------------------------ :   -
TrCHSc4: ------------------------------------------------------ :   -
TrCHSc5: ------------------------------------------------------ :   -
TrCHSc6: ------------------------------------------------------ :   -
TrCHSc7: GGGCGGCTGACGGAGGAGGGCATAAGTTTCACGCTAGCGAGGGAACTGCCGCAGATA : 584
```

FIGURE 21 (cont)

```
                      *        20         *        40         *        60
TrCHSd : GTAGCAACACACACTTTGATTTCTTTTTGAGTCCTTGCTACGTGGCNTTACCAAAAAACG :  60

*        80         *       100         *       120
TrCHSd : TTGCTAAGTCATCAACCATTCCAATTCCTTAATATAACCTATCAGTACTCACCATCTTTT : 120

*       140         *       160         *       180
TrCHSd : CTTCCTCCCTGCTAACTTTATACTTAGAGAAGATGGTGAAAGTTAATGAGATCCGCCAGG : 180

*       200         *       220         *       240
TrCHSd : CACAGAGAGCTGAAGGCCCTGCCACTGTGTTGGCAATCGGCACTGCAACTCCTCCAAACT : 240

*       260         *       280         *       300
TrCHSd : GTGTTGATCAGAGTACATACCCCGACTACTACTTCCGCATCACAAACAGTGAGCACAAGA : 300

*       320         *       340         *       360
TrCHSd : CAGAGCTCAAAGAAAAATTCCAGCGCATGTGTGACAAATCTATGATTAAGAAGAGATACA : 360

*       380         *       400         *       420
TrCHSd : TGCATTTGACAGAAGAGATTTTGAAGGAGAATCCAAGTTTATGTGAGTACATGGCACCTT : 420

*       440         *       460         *       480
TrCHSd : CATTGGATGCAAGACAAGACATGGTGGTTGTGGAAGTACCAAGGCTAGGAAAAGAGGCAG : 480

*       500         *       520         *       540
TrCHSd : CAACAAAGGCAATCAAGGAATGGGGTCAACCTAAGTCCAAGATTACCCACCTCATCTTTT : 540

*       560         *       580         *       600
TrCHSd : GCACCACAAGTGGTGTGGACATGCCCGGTGCCGACTATCAGCTTACAAAGCTTTTAGGCC : 600

*       620         *       640         *       660
TrCHSd : TTCGTCCGCATGTGAAGCGTTACATGATGTACCAACAAGGTTGTTTTGCTGGTGGCACGG : 660

*       680         *       700         *       720
TrCHSd : TGCTTCGTTTGGCTAAAGACTTGGCTGAAAACAACAAAGGTGCCCGTGTATTGGTGGTTT : 720

*
TrCHSd : GTTCAGAGATAACTG : 735
```

FIGURE 22

```
            *        20         *        40         *        60
TrCHSd : MVKVNEIRQAQRAEGPATVLAIGTATPPNCVDQSTYPDYYFRITNSEHKTELKEKFQRMC :  60

*        80         *       100         *       120
TrCHSd : DKSMIKKRYMHLTEEILKENPSLCEYMAPSLDARQDMVVVEVPRLGKEAATKAIKEWGQP : 120

*       140         *       160         *       180
TrCHSd : KSKITHLIFCTTSGVDMPGADYQLTKLLGLRPHVKRYMMYQQGCFAGGTVLRLAKDLAEN : 180

*
TrCHSd : NKGARVLVVCSEIT : 194
```

FIGURE 23

```
              *         20         *         40         *         60
TrCHSd1  : GTAGCAACACACACTTTGATTTCTTTTTGAGTCCTTGCTACGTGGCNTTACCAAAAAACG : 60
TrCHSd2  : GTAGCAACACACACTTTGATTTCTTTTTTGAGTCCTTGCTACGTGGCTTTACCAAAAAACG : 60
TrCHSd3  : GTAGCAACACACACTTTGATTTCTTTTTGAGTCCTTGCTACGTGGCTTTACCAAAAAACG : 60
TrCHSd4  : ----------NNNCACNCACACTTTTTTGNATCCCTGCTACGTGGCNTTACCAAAAAACG : 50
TrCHSd5  : ------------------------------------------------------------ : -
TrCHSd6  : ------------------------------------------------------------ : -
TrCHSd7  : ------------------------------------------------------------ : -
TrCHSd8  : ------------------------------------------------------------ : -
TrCHSd9  : ------------------------------------------------------------ : -
TrCHSd10 : ------------------------------------------------------------ : -
TrCHSd11 : ------------------------------------------------------------ : -

*         80         *        100         *        120
TrCHSd1  : TTGCTAAGTCATCAACCATTCCAATTCCTTAATATAACCTATCAGTACTCACCATCTTTT :120
TrCHSd2  : TTGCTAAGTCATCAACCATTCCAATTCCTTAATATAACCTATCAGTACTCACCATCTTTT :120
TrCHSd3  : TTGCTAAGTNATCAACCATTCCAATTCCTTAATATAACCTATCAGTACTCACCATCTTTT :120
TrCHSd4  : TTGCTAAGTCNTCAACCATTCCAATTCCTTAATATAACCTATCAGTACTCACCATCTTTT :110
TrCHSd5  : --------------------------------------------------TNATCNCT : 10
TrCHSd6  : --------------------------------------------------TTNATNCNT : 10
TrCHSd7  : ------------------------------------------------------TCCNAT :  6
TrCHSd8  : ------------------------------------------------------------ : -
TrCHSd9  : ------------------------------------------------------------ : -
TrCHSd10 : ------------------------------------------------------------ : -
TrCHSd11 : ------------------------------------------------------------ : -

*        140         *        160         *        180
TrCHSd1  : CTTCCTCCCTGCTAACTTTAGACTGAGAAGATGGTGAAAGTTAATGAGATCCGCCAGG :180
TrCHSd2  : CTTCCTCCCTGCTAACTTTAGACTGAGAAGATGGTGAAAGTTAATGAGATCCGCCAGG :180
TrCHSd3  : CTTCCTCCCTGCTAACTTTAGACTGAGAAGATGGTGAAAGTTAATGAGATCCGCCAGG :180
TrCHSd4  : CTTCCTCCCTGCTAACTTTAGACTGAGAAGATGGTGAAAGTTAATGAGATCCGCCAGG :170
TrCHSd5  : ATNTGCTTTCTTGTTACTTANAGAAGATGGTAGAGTTAATGAGATCCGCCAGG : 70
TrCHSd6  : ATNTAGCTTTCCTTGTTACTTANAGAAGATGGTNAGAGTTAATGAGATCCGCCAGG : 70
TrCHSd7  : ATATAGTTTCTTTGTTACTTNAGAAGATGGTNAAGTTAATGAGATCCGCCAGG : 66
TrCHSd8  : -------GCNNTGACTTTANAATNNGANAAGATGGTGAAAGTTAATGAGATCCGCCAGG : 53
TrCHSd9  : -----------TNNNTTTANAATNNGAGAAGATGGTGAAAGTNAATGAGATCCGCCAGG : 48
TrCHSd10 : ----------TTGTTNATTGNACAANATGGTNAGAGTTAATGAGATCCGCCNGG : 45
TrCHSd11 : ------------------------------------------------------------ : -

*        200         *        220         *        240
TrCHSd1  : CACAGAGAGCTGAAGGCCCTGCCACTGTGTTGGCAATCGGCACTGCAACTCCTCCAAACT :240
TrCHSd2  : CACAGAGAGCTGAACGCCCTGCCACCGTGTTGGCAATCGGCACTGCAACTCCTCCAAACT :240
TrCHSd3  : CACAGAGAGCTGAAGGCCCTGCCACCGTGTTGGCAATCGGCACTGCAACTCCTCCAAACT :240
TrCHSd4  : CACAGAGAGCTGAAGGCCCTGCCACCGTGTTGGCAATCGGCACTGCAACTCCTCCAAACT :230
TrCHSd5  : CACAGAGAGCTGAAGGCCCTGCAACTGTGTTGCAATCGGCACTGCAACTCCTAAAAACT :130
TrCHSd6  : CACAGAGAGCTGAAGGCCCTGCAACTGTGTTGCAATCGGCACTGCAACTCCTAAAAACT :130
TrCHSd7  : CACAGAGAGCTGAAGGCCCTGCAACTGTGTTGCAATCGGCACTGCAACTCCTAAAAACT :126
TrCHSd8  : CACAGANAGCTGAAGGCCCTGCCACTGTGTTGGNANTNGGCACTGCAACTCCTCCAAACT :113
TrCHSd9  : CACAGAGAGCTGAAGGCCCTGCCACTGTGTTGGCAATCGGCACTGCAACTCCTCCAAACT :108
TrCHSd10 : CACANAGAGCGGAAGGCCCTGCNCCTGTGTTTGCAATCGGCACTGCAACTCCTAAAAACT :105
TrCHSd11 : ------------------------------------------TAAACT :  7
```

FIGURE 24

```
              *         260         *         280         *         300
TrCHSd1  : GTGTCGATCAGAGTACATACCCGGACTACTACTTCCGCATCACAAACAGTGAGCACAAGA :300
TrCHSd2  : GTGTCGATCAGAGTACATACCCAGACTACTACTTCCGCATCACAAACAGTGAGCACAAGA :300
TrCHSd3  : GTGTCGATCAGAGTACATACCCAGACTACTACTTCCGCATCACAAACAGTGAGCACAAGA :300
TrCHSd4  : GTGTTGATCAGAGTACATACCCGGACTACTACTTCCGCATCACAAACAGTGAGCACAAGA :290
TrCHSd5  : GTGTTGATCAGAGTACTTACCCCGACTACTATTTCCGAATCACAAACAGCGAACACAAGA :190
TrCHSd6  : GTGTTGATCAGAGTACTTACCCCGACTACTATTTCCGAATCACAAACAGCGAACACAAGA :190
TrCHSd7  : GTGTTGATCAGAGTACTTACCCCGACTACTATTTCCGAATCACAAACAGCGAACACAAGA :186
TrCHSd8  : GTGTCGATCAGAGTACATACCCGGACTACTACTTCCGCATCACAAACAGTGAGCACAAGA :173
TrCHSd9  : GTGTCGATCAGAGTACATACCCGGACTACTACTTCCGCATCACAAACAGTGAGCACAAGA :168
TrCHSd10 : GTGTTGATCAGAGTACTTACCCCGACTACTATTTCCGAATCACAAACAGCGAACACAAGA :165
TrCHSd11 : GTGTTGATCNGAGTACTTACCCCGACTNCTATTTCCGAATNNCAAACAGCGAACACAAGA : 67

*         320         *         340         *         360
TrCHSd1  : CAGAGCTCAAAGAAAAATTCCAGCGCATGTGTGACAAATCTATGATTAAGAAGAGATACA :360
TrCHSd2  : CAGAGCTCAAAGAAAAATTCCAGCGCATGTGTGACAAATCTATGATTAAGAAGAGATACA :360
TrCHSd3  : CAGAGCTCAAAGAAAAATTCCAGCGCATGTGTGACAAATCTATGATTAAGAAGAGATACA :360
TrCHSd4  : CAGAGCTCAAAGAAAAATTCCAGCGCATGTGTGACAAATCTATGATTAAGAAGAGATACA :350
TrCHSd5  : CAGAGCTCAAAGAAAAATTCCAGCGCATGTGTGACAAATCTATGATTAAGAAGAGATACA :250
TrCHSd6  : CAGAGCTCAAAGAAAAATTCCAGCGCATGTGTGACAAATCTATGATTAAGAAGAGATACA :250
TrCHSd7  : CAGAGCTCAAAGAAAAATTCCAGCGCATGTGTGACAAATCTATGATTAAGAAGAGATACA :246
TrCHSd8  : CAGAGCTCAAAGAAAAATTCCAGCGCATGTGTGACAAATCTATGATTAAGAAGAGATACA :233
TrCHSd9  : CAGAGCTCAAAGAAAAATTCCAGCGCATGTGTGACAAATCTATGATTAAGAAGAGATACA :228
TrCHSd10 : CAGAGCTCAAAGAAAAATTCCAGCGCATGTGTGACAAATCTATGATTAAGAAGAGATACA :225
TrCHSd11 : CAGAGCTCAAAGAAAAATTCCAGCGCATGTGTGACAAATCTATGATTAAGAAGAGATACA :127

*         380         *         400         *         420
TrCHSd1  : TGCATTTGACAGAAGAGATTTTGAAGGAGAATCCAAGTTTATGTGAGTACATGGCACCTT :420
TrCHSd2  : TGCATTTGACAGAAGAGATTTTGAACGAGAATCCAAGTTTATGTCAGTACATGGCACCTT :420
TrCHSd3  : TGCATTTGACAGAAGAGATTTTGAAGGAGAATCCAAGTTTATGTGAGTACATGGCACCTT :420
TrCHSd4  : TGCATTTGACAGAAGAGATTTTGAAGGAGAATCCAAGTTTATGTGAGTACATGGCACCTT :410
TrCHSd5  : TGCATTTGACAGAAGAGATTTTGAAGGAGAATCCAAGTTTATGTGAGTACATGGCACCTT :310
TrCHSd6  : TGCATTTGACAGAAGAGATTTTGAAGGAGAATCCAAGTTTATGTGAGTACATGGCACCTT :310
TrCHSd7  : TGCATTTGACAGAAGAGATTTTGAAGGAGAATCCAAGTTTATGTGAGTACATGGCACCTT :306
TrCHSd8  : TGCATTTGACAGAAGAGATTTTGAAGGAGAATCCAAGTTTATGTGAGTACATGGCACCTT :293
TrCHSd9  : TGCATTTGACAGAAGAGATTTTGAAGGAGAATCCAAGTTTATGTGAGTACATGGCACCTT :288
TrCHSd10 : TGCATTTGACAGAAGAGATTTTGAAGGAGAATCCAAGTTTATGTGAGTACATGGCACCTT :285
TrCHSd11 : TGCATTTGACAGAAGAGATTTTGAAGGAGAATCCAAGNTTATGTGAGTACATGGCACCTT :187

*         440         *         460         *         480
TrCHSd1  : CATTGGATGCAAGACAAGACATGGTGGTTGTGGAAGTACCAAGGCTAGGAAAAGAGGCAG :480
TrCHSd2  : CATTGGATGCAAGACAAGACATGGTGGTTGTGGAAGTACCAAGGCTAGGAAAAGAGGCTG :480
TrCHSd3  : CATTGGATGCAAGACAAGACATGGTGGTTGTGGAAGTACCAAGGCTAGGAAAAGAGGCTG :480
TrCHSd4  : CATTGGATGCAAGACAAGACATGGTGGTTGTGGAAGTACCNAGGCTAGGAAAAGAGGCAG :470
TrCHSd5  : CATTGGATGCAAGACAAGACATGGTGGTTGTGGAAGTACCAAGGCTAGGAAAAGAGGCTG :370
TrCHSd6  : CATTGGATGCAAGACAAGACATGGTGGTTGTGGAAGTACCAAGGCTAGGAAAAGAGGCTG :370
TrCHSd7  : CATTGGATGCAAGACAAGACATGGTGGTTGTGGAAGTACCAAGGCTAGGAAAAGAGGCTG :366
TrCHSd8  : CATTGGATGCAAGACAAGACATGGTGGTTGTGGAAGTACCAAGGCTAGGAAAAGAGGCAG :353
TrCHSd9  : CATTGGATGCAAGACAAGACATGGTGGTTGTGGAAGTACCAAGGCTAGGAAAAGAGGCAG :348
TrCHSd10 : CATTGGATGCAAGACAAGACATGGTGGTAGTGGAAGTACCAAGGCTAGGAAAAGAGGCAC :345
TrCHSd11 : NATTGGATGCAAGACAAGACATGGNGGCCGCCCACCNNCCNTCCNCCNCACCNCAACCCN :247
```

FIGURE 24 (cont)

```
                    *         500         *         520         *         540
TrCHSd1  : CAACAAAGGCAATTAAGGAATGGGGTCAACCTAAGTCCAAGATTACCCACCTCATCTTTT :540
TrCHSd2  : CAACAAAGGCTATCAAGGAATGGGGTCAACCTAAGTCCAAGATTACTCACCTCATCTTTT :540
TrCHSd3  : CAACAAAGGCTATCAAGGAATGGGGTCAACCTAAGTCCAAGATTACTCACCTCATCTTTT :540
TrCHSd4  : TAACAAAGGCAATTAGGGAATGGGGTCAACCTAAGTNCAAGATTACCCACCTCATCTTTT :530
TrCHSd5  : CAACAAAGGCTATCAAGGAATGGGGTCAACCTAAGTCCAAGATTACCCACCTCATCTTTT :430
TrCHSd6  : CAACAAAGGCTATCAAGGAATGGGGTCAACCTAAGTCCAAGATTACTCACCTCATCTTTT :430
TrCHSd7  : CAACAAAGGCTATCAAGGAATGGGGTCAACCTAAGTCCAAGATTACTCACCTCATCTTTT :426
TrCHSd8  : CAACAAAGGCAATTAAGGAATGGGGCCAACCTAAGTCCAAGATTACCCACCTCATCTTTT :413
TrCHSd9  : CAACAAAGGCAATTAAGGAATGGGGCCAACCTAAGTCCAAGATTACCCACCTCATCTTTT :408
TrCHSd10 : CAACAAAGGCAATTAAAGAATGGGGTCAACCTAAGTCCAAGATTACCCACCTCATCTTTT :405
TrCHSd11 : CCN--------------------------------------------------------- :250

*         560         *         580         *         600
TrCHSd1  : GCACCACAAGTGGTGTGGACATGCCCGGTGCCGC--------------------------- :574
TrCHSd2  : GCACCACAAGTGGTGTGGACATGCCTGGCGCCCACTATCAGCTTACAAAGCTTTTAG--- :597
TrCHSd3  : GCACCACAAGTGGTGTGGACATGCCTGGGGCCGACTATCAGCTTACAAAGCTTTTAGGCC :600
TrCHSd4  : GCACCACAAGTGGTGTGGACATGCCCGGTGCCGACTATCAGCTTACAAAGCTTT----- :585
TrCHSd5  : GCACCACAACTGGTGTGGACATGCCTGGTGCCGACTATCAGCTTACAAAGCTTTTAGGCC :490
TrCHSd6  : GCACCACAAGTGGTGTGGACATGCCTGGTGCCGACTATCAGCTTACAAAGCTTTTAGGCC :490
TrCHSd7  : GCACCACAAGTGGTGTGGACATGCCTGGTGCCGACTATCAGCTTACAAAGCTTTTAGGCC :486
TrCHSd8  : GCACCACAAGTGGTGTGGACATGCCCGGTGCCGACTATCAGCTTACAAAGCTTTTAGGCC :473
TrCHSd9  : GCACCACAAGTGGTGTGGACATGCCCGGTGCCGACTATCAGCTTACAAAGCTTTTAGGCC :468
TrCHSd10 : GCACCACAAGTGGTGTGGACATGCCCGGTGCCGACTATCAGCTTACAAAGCTTTTAGGCC :465
TrCHSd11 : ------------------------------------------------------------ : -

*         620         *         640         *         660
TrCHSd1  : ------------------------------------------------------------ : -
TrCHSd2  : ------------------------------------------------------------ : -
TrCHSd3  : TTCGTCCGCATGTGAN--------------------------------------------- :616
TrCHSd4  : ------------------------------------------------------------ : -
TrCHSd5  : TTCGTCCGCATGTGAAGCGTTATATGATGTACCAACAAGGTTGTTTTGCTGGTGGCACGG :550
TrCHSd6  : TTCGTCCGCATGTGAAGCGTTATATGATGTACCAACAAGGTTGTTTTGCTGGTGGCACGG :550
TrCHSd7  : TTCGTCCGCATGTGAAGCGTTATATGATGTACCAACAAGGTTGTTTTGCTGGTGGCACGG :546
TrCHSd8  : TGCGTCCATATGTGAAGCGTTACATGATGTACCAACAAGGTTGTTTTGCTGGTGGCACCG :533
TrCHSd9  : TCCGTCCATATGTGAAGCGTTACATGATGTATCAACAAGGTTGTTTTGCTGGTGGCACGG :528
TrCHSd10 : TGCGTCCATATGTGAAGCGTTACATGATGTATCAACAAGGTTGTTTTGCTGGTGGCACGG :525
TrCHSd11 : ------------------------------------------------------------ : -

*         680         *         700         *         720
TrCHSd1  : ------------------------------------------------------------ : -
TrCHSd2  : ------------------------------------------------------------ : -
TrCHSd3  : ------------------------------------------------------------ : -
TrCHSd4  : ------------------------------------------------------------ : -
TrCHSd5  : TGCTTCGTTTGGCTAAAGACTTGGCTGAAAACAACAAAGGTGCCCG-------------- :596
TrCHSd6  : TGCTTCGTTTGGCTAAAGACTTGGCTGAAAACAACAAAGGTGCCCGTGTATTGGTGGTTT :610
TrCHSd7  : TGCTTCGTTTGGCTAAAGACTTGGCTGAAAACAACAAAGGTGCCCGTGTATTGGTGGTTT :606
TrCHSd8  : TGCTTCGTTTGGCTAAAGACTTGGCTGAAAACAACAAN---------------------- :571
TrCHSd9  : TGCTTCGTTTGGCTAAAGACTTGGCTGAAAACAACAAAGGTGCCCGTGTGTTGGTGGTTT :588
TrCHSd10 : TACTTCGTTTGGCTAAAGACTTGGCTGAAAACAACAAAGGTGCCCGTGTGTTGGTGGTTT :585
TrCHSd11 : ------------------------------------------------------------ : -
```

FIGURE 24 (cont)

```
TrCHSd1  : ---------------- :   -
TrCHSd2  : ---------------- :   -
TrCHSd3  : ---------------- :   -
TrCHSd4  : ---------------- :   -
TrCHSd5  : ---------------- :   -
TrCHSd6  : GTTCAGAG-------- : 618
TrCHSd7  : GTT------------- : 609
TrCHSd8  : ---------------- :   -
TrCHSd9  : GTTCANAGATAACTG  : 603
TrCHSd10 : GTT------------- : 588
TrCHSd11 : ---------------- :   -
```

FIGURE 24 (cont)

```
              *        20         *        40         *        60
TrCHSe : GNAGCAACACACACTTTGATTTCTTTTTGAATCCCTGCTACGTGGCNCACCAAAAAACGT :  60

*        80         *       100         *       120
TrCHSe : TGCTAAGTCATCAACCATTCCAATTCCTTAATATAACCTATCAGTACTCACCATCTTTTC : 120

*       140         *       160         *       180
TrCHSe : TTCCTCCCTGCTAACTTTAGACTCAGTAGAAGATGGTGAATGTTAATGAGATCCGCCAGG : 180

*       200         *       220         *       240
TrCHSe : CACAGAGAGCTGAAGGCCCTGCCACCGTGTTGGCAATCGGCACTGCAACTCCTCCAAACT : 240

*       260         *       280         *       300
TrCHSe : GTGTTGATCAGAGTACATACCCGGACTACTACTTCCGCATCACAAACAGTGAGCACAAGA : 300

*       320         *       340         *       360
TrCHSe : CAGAGCTCAAAGAAAAATTCCAGCGCACGTGTAAGATATTTATCTTATACTCCATGCATG : 360

*       380         *       400         *       420
TrCHSe : TCTTTTTCTGCTGACTGCCGTGTTTATATATTGTTTTGTTTGTTCCTTAAATTTGTTAT : 420

*       440         *       460         *       480
TrCHSe : GTCACTCTCACATGTACAAAACACTTAAGACTAAACTGCATATCATTTTTTTCAGGGACA : 480

*       500         *       520         *       540
TrCHSe : AATCTATGATTAAGAAGAGATACATGCATTTGACAGAAGAGATTTTGAAGGAGAATCCAA : 540

*       560         *       580
TrCHSe : GTTTATGTGAGNACATGGCACCTTCTTGGGATGCAAGACAAGT : 583
```

FIGURE 25

```
                  *        20         *        40         *        60
TrCHSe : MVNVNEIRQAQRAEGPATVLAIGTATPPNCVDQSTYPDYYFRITNSEHKTELKEKFQRTR : 60

*        80         *
TrCHSe : DKSMIKKRYMHLTEEILKENPSLCEXMAPSWDARQ : 95
```

FIGURE 26

```
                    *         20         *         40         *         60
TrCHSe1 : GNAGCAACACACACTTTGATTTCTTTTTGAATCCCTGCTACGTGGCTTACCAAAAAACGT :  60
TrCHSe2 : ----------------------------GTCCCTGCTGCGTGGCNCACC-AAAAACGT :  29

*         80         *        100         *        120
TrCHSe1 : TGCTAAGTCATCAACCATTCCAATTCCTTAATATAACCTATCAGTACTCACCATTTTTTC : 120
TrCHSe2 : TGCTNAGT-NTGAACC-TTCC-ATTCCTTAATATAACCTATCAGTACTCACCATCTTTTC :  86

*        140         *        160         *        180
TrCHSe1 : TTCCTCCCTGCTAACTTTAGACTCAG-AGAAGATGGTGAATGTTAATGAGATCCGCCAGG : 179
TrCHSe2 : TTCCTCCCTGCTAACTTTAGACTCAGTAGAAGATGGTGAATGTTAATGAGATCCGCCAGG : 146

*        200         *        220         *        240
TrCHSe1 : CACAGAGAGCTGAAGGCCCTGCCACCGTGTTGGCAATCGGCACTGCAACTCCTCCAAACT : 239
TrCHSe2 : CACAGAGAGCTGAAGGCCCTG--------------------------------------- : 167

*        260         *        280         *        300
TrCHSe1 : GTGTTGATCAGAGTACATACCCGGACTACTACTTCCGCATCACAAACAGTGAGCACAACA : 299
TrCHSe2 : ------------------------------------------------------------ :   -

*        320         *        340         *        360
TrCHSe1 : CAGAGCTCAAAGAAAAATTCCAGCGCACGTGTAAGATATTTATCTTATACTCCATGCATG : 359
TrCHSe2 : ------------------------------------------------------------ :   -

*        380         *        400         *        420
TrCHSe1 : TCTTTTTCTGCTGACTGCCGTGTTTATATATTGTTTGTTTTGTTCCTTAAATTTGTTAT : 419
TrCHSe2 : ------------------------------------------------------------ :   -

*        440         *        460         *        480
TrCHSe1 : GTCACTCTCACATGTACAAAACACTTAAGACTAAACTGCATATCATTTTTTTCAGGGACA : 479
TrCHSe2 : ------------------------------------------------------------ :   -

*        500         *        520         *        540
TrCHSe1 : AATCTATGATTAAGAAGAGATACATGCATTTGACAGAAGAGATTTTGAAGGAGAATCCAA : 539
TrCHSe2 : ------------------------------------------------------------ :   -

*        560         *        580
TrCHSe1 : CTTTATGTGAGNACATGGCACCTTCTTGGGATGCAAGACAAGT : 582
TrCHSe2 : ------------------------------------------- :   -
```

FIGURE 27

```
                  *        20         *        40         *        60
TrCHSf : GCNTAAGCCTTGATTNTTGTTTGTTTCCTAACACAAGAACTAGTGTTTGCTTGAATCTTA :  60

*        80         *       100         *       120
TrCHSf : AGAAAAAATGCCTCAAGGTGATTTGAATGGAAGTTCCTCGGTGAATGGAGCACGTGCTAG : 120

*       140         *       160         *       180
TrCHSf : ACGTGCTCCTACTCAGGGAAAGGCAACGATACTTGCATTAGGAAAGGCTTTCCCCGCCCA : 180

*       200         *       220         *       240
TrCHSr : AGTCCTCCCTCAAGAGTGCTTGGTGGAAGGATTCATTCGCGACACTAAGTGTGACGATAC : 240

*       260         *       280         *       300
TrCHSf : TTATATTAAGGAGAAATTGGAGCGTCTTTGCAAAAACACAACTGTAAAAACAAGATACAC : 300

*       320         *       340         *       360
TrCHSf : AGTAATGTCAAAGGAGATCTTAGACAACTATCCAGAGCTAGCCATAGATGGAACACCAAC : 360

*       380         *       400         *       420
TrCHSf : AATAAGGCAAAAGCTTGAAATAGCAAATCCAGCAGTAGTTGAAATGGCAACAAGAGCAAG : 420

' *       440         *       460         *       480
TrCHSf : CAAAGATTGCATCAAAGAATGGGGAAGGTCACCTCAAGATATCACACACATAGTCTATGT : 480

*       500         *       520         *       540
TrCHSf : TTCCTCGAGCGAAATTCGTCTACCCGGTGGTGACCTTTATCTTGCAAATGAACTCGGCTT : 540

*       560         *       580         *       600
TrCHSf : AAACAGCGATGTTAATCGCGTAATGCTCTATTTCCTCGGTTGCTACGGCGGTGTCACTGG : 600

*
TrCHSf : CTTACGTGTCGCC : 613
```

FIGURE 28

```
              *        20         *        40         *        60
TrCHSf :  MPQGDLNGSSSVNGARARRAPTQGKATILALGKAFPAQVLPQECLVEGFIRDTKCDDTYI :  60

*        80         *        100        *        120
TrCHSf :  KEKLERLCKNTTVKTRYTVMSKEILDNYPELAIDGTPTIRQKLEIANPAVVEMATRASKD : 120

*        140        *        160        *        180
TrCHSf :  CIKEWGRSPQDITHIVYVSSSEIRLPGGDLYLANELGLNSDVNRVMLYFLGCYGGVTGLR : 180

TrCHSf :  VA : 182
```

FIGURE 29

```
                    *        20         *        40         *        60
TrCHSf1 : GCNTAAGCCTTCATTNTTGTTTGTTTCCTAACACAAGAACTAGTGTTTGCTTGAATCTTA :  60
TrCHSf2 : ---TAAGCCTTGATTNTTGTTTGTTTCCTAACACAAGAACTAGTGTTTGCTTGAATCTTA :  57
TrCHSf3 : --------TTCATTNTTGTTTGTTTCCTAACACAAGAACTNGTGTTTGCTTGAATCTTA  :  51
TrCHSf4 : ------------------GTTTGTTTCCTAACACAAGAACTAGTGTTTGCTTGAATCTTA :  42

*        80         *       100         *       120
TrCHSf1 : AGAAAAAATGCCTCAAGGTGATTTGAATGGAAGTTCCTCGGTGAATGGAGCACGTGCTAG : 120
TrCHSf2 : AGAAAAAATGCCTCAAGGTGATTTGAATGGAAGTTCCTCGGTGAATGGAGCACGTGCTAG : 117
TrCHSf3 : AGAAAAAATGCCTCAAGGTGATTTGAATGGAAGTTCCTCGGTGAATGGAGCACGTGCTAG : 111
TrCHSf4 : AGAAAAAATGCCTCAAGGTGATTTGAATGGAAGTTCCTCGGTGAATGGAGCACGTGCTAG : 102

*       140         *       160         *       180
TrCHSf1 : ACGTGCTCCTACTCAGGGAAAGGCAACGATACTTGCATTAGGAAAGGCTTTCCCCGCCCA : 180
TrCHSf2 : ACGTGCTCCTACTCAGGGAAAGGCAACGATACTTGCATTAGGAAAGGCTTTCCCCGCCCA : 177
TrCHSf3 : ACGTGCTCCTACTCAGGGAAAGGCAACGATACTTGCATTAGGAAAGGCTTTCCCCGCCCA : 171
TrCHSf4 : ACGTGCTCCTACTCAGGGAAAGGCAACGATACTTGCATTAGGAAAGGCTTTCCCCGCCCA : 162

*       200         *       220         *       240
TrCHSf1 : AGTCCTCCCTCAAGAGTGCTTGGTGGAAGGATTCATTCGCGACACTAAGTGTGACGATAC : 240
TrCHSf2 : GGTCCTCCCTCAAGAGTGCTTGGTGGAAGGATTCATTCGCGACACTAAGTGTGACGATAC : 237
TrCHSf3 : GCTCCTCCCTCAAGAGTGCTTGGTGGAAGGATTCATTCGCGACACTAAGTGTGACGATAC : 231
TrCHSf4 : AGTCCTCCCTCAAGAGTGCTTGGTGGAAGGATTCATTCGCGACACTAAGTGTGACGATAC : 222

*       260         *       280         *       300
TrCHSf1 : TTATATTAAGGAGAAATTGGAGCGTCTTTGCAAAAACACAACTGTAAAAACAAGATACAC : 300
TrCHSf2 : TTATATTAAGGAGAAATTGGAGCGTCTTTGCAAAAACACAACTGTGAAAACAAGATACAC : 297
TrCHSf3 : TTATATTAAGGAGAAATTGGAGCGTCTTTGCAAAAACACAACTGTGAAAACAAGATACAC : 291
TrCHSf4 : TTATATTAAGGAGAAATTGGAGCGTCTTTGCAAAAACACAACTGTAAAAACAAGATACAC : 282

*       320         *       340         *       360
TrCHSf1 : AGTAATGTCAAAGGAGATCTTAGACAACTATCCAGAGCTAGCCATAGATGGAACACCAAC : 360
TrCHSf2 : AGTAATGTCAAAGGAGATCTTAGACAACTATCCAGAGCTAGCCATAGATGGAACACCAAC : 357
TrCHSf3 : AGTAATGTCAAAGGAGATCTTAGACAACTATCCAGAGCTAGCCATAGATGGAACACCAAC : 351
TrCHSf4 : AGTAATGTCAAAGGAGATCTTAGACAACTATCCAGAGCTAGCCATAGATGGAACACCAAC : 342

*       380         *       400         *       420
TrCHSf1 : AATAAGGCAAAAGCTTGAAATAGCAAATCCAGCAGTAGTTGAAATGGCAACAAGAGCAAG : 420
TrCHSf2 : AATAAGGCAAAAGCTTGAAATAGCAAATCCAGCAGTAGTTGAAATGGCAACAAGAGCAAG : 417
TrCHSf3 : AATAAGGCAAAAGCTTGAAATAGCAAATCCAGCAGTAGTTGAAATGGCAACAAGAGCAAG : 411
TrCHSf4 : AATAAGGCAAAAGCTTGAAATAGCAAATCCAGCAGTAGTTGAAATGGCAACAAGAGCAAG : 402

*       440         *       460         *       480
TrCHSf1 : CAAAGATTGCATCAAAGAATGGGGAAGGTCACCTCAAGATATCACACACATAGTCTATGT : 480
TrCHSf2 : CAAAGATTGCATCAAAGAATGGGGAAGGTCACCTCAAGATATCACACACATAGTCTATGT : 477
TrCHSf3 : CAAAGATTGCATCAAAGAATGGGGAAGGTCACCTCAAGATATCACACACATAGTCTATGT : 471
TrCHSf4 : CAAAGATTGCATCAAAGAATGGGGAAGGTCACCTCAAGATATCACACACATAGTCTATGT : 462
```

FIGURE 30

```
                    *         500         *         520         *         540
TrCHSf1 : TTCCTCGAGCGAAATTCGTCTACCCGGTGGTGACCTTTATCTTGCAAATGAACTCGGCTT : 540
TrCHSf2 : TTCCTCGAGCGAAATTCGTCTACCCGGTGGTGACCTTTATCTTGCAAATGAACTCGGCTT : 537
TrCHSf3 : TTCCTCGAGCGAAATTCGTCTACCCGGTGGTGACCTTTATCTTGCAAATGAACTCGGCTT : 531
TrCHSf4 : TTCCTCGAGCGAAATTCGTCTACCCGGTGGTGACCTTTATCTTGCAAATGAACTCGGCTT : 522

*         560         *         580         *         600
TrCHSf1 : AAACAGCGATGTTAATCGCGTAATGCTCTATTTCCTCGGTTGCTACGGCGGTGTCACTGG : 600
TrCHSf2 : AAACAGCGATGTTAATCGCGTAATGCTCTATTT--------------------------- : 570
TrCHSf3 : AAACAGCGATGTTAATCGCGTAATGCTCTATTTCCTCGGTTGCT---------------- : 575
TrCHSf4 : AAACAGCGATGTTAATCGCGTAATGCTCTATTTCCTCGGTTGCTACGGCGG--------- : 573

*
TrCHSf1 : CTTACGTGTCGCC : 613
TrCHSf2 : ------------- :  -
TrCHSf3 : ------------- :  -
TrCHSf4 : ------------- :  -
```

FIGURE 30 (cont)

```
                    *        20         *        40         *        60
TrCHSg : GTATACCAAGGTTGTTTTGCTGGTGGCACGGTACTTCGTTTGGCTAAAGACTTGGCTGAA :  60

*        80         *       100         *       120
TrCHSg : AACAACAAAGGTGCCCGTGTGTTGGTGGTTTGTTCAGAGATAACTGCAGTTACTTTCCGT : 120

*       140         *       160         *       180
TrCHSg : GGACCCAGTGACACTCACCTTGATAGCCTTGTGGGCAAGCATTGTTTGGAGATGGTGCA : 180

*       200         *       220         *       240
TrCHSg : GCAGCTGTGATTGTTGGTTCAGACCCTTTGCCAGAAGTTGAGAAGCCTTTGTTTGAATTG : 240

*       260         *       280         *       300
TrCHSg : GTATGGACCGCACAAACAATCGCTCCAGATAGTGAAGGAGCCATTGATGGTCACCTTCGC : 300

*       320         *       340         *       360
TrCHSg : GAAGCAGGGCTGACATTCCATCTCCTCAAGGATGTTCCTAGCCTTGTCTCAAATAACATT : 360

*       380         *       400         *       420
TrCHSg : GAGAAAGCGCTTGTTGATGCCTTTCAACCTTTGAATATTTCTGACTACAATTCCATCTTT : 420

*       440         *       460         *       480
TrCHSg : TGGATTGCACACCCAGGCGGACCAGCAATTCTTGACCAAGTTGAAGCTAAGTTAGGCTTA : 480

*       500         *       520         *       540
TrCHSg : AAGCCAGAGAAAATGCAAGCCACTCGACATGTACTTAGCGAATATGGTAACATGTCAAGT : 540

*       560         *       580         *       600
TrCHSg : GCGTGTGTGTTATTTATCTTGGATGAGATGAGGAGGAAGTCAAAAGAAGACGGACTTGCC : 600

TrCHSg : ACAACAG : 607
```

FIGURE 31

```
                  *        20         *        40         *        60
TrCHSg : VYQGCFAGGTVLRLAKDLAENNKGARVLVVCSEITAVTFRGPSDTHLDSLVGQALFGDGA :  60

*        80         *       100         *       120
TrCHSg : AAVIVGSDPLPEVEKPLFELVWTAQTIAPDSEGAIDGHLREAGLTFHLLKDVPSLVSNNI : 120

*       140         *       160         *       180
TrCHSg : EKALVDAFQPLNISDYNSIFWIAHPGGPAILDQVEAKLGLKPEKMQATRHVLSEYGNMSS : 180

*       200
TrCHSg : ACVLFILDEMRRKSKEDGLATT : 202
```

FIGURE 32

```
                  *         20         *         40         *         60
TrCHSg1 : GTATACCAAGGNTGTTTTGCTGGTGGCACGGTACTTCGTTTGGCTNAAGACTTGGCTGAA :  60
TrCHSg2 : -----CCAAGGTTGTTTTGCTGGTGGCACGGTACTTCGTTTGGCTAAAGACTTGGCTGAA :  55
TrCHSg3 : --------GGTTGTTTTGCTGGTGGCACGGTACTTCGTTTGGCTAAAGACTTGGCTGAA :  51

*         80         *        100         *        120
TrCHSg1 : AACAACAAAGGTGCCCGTGTGTTGGTGGTTTGTTCAGAGATAACTGCAGTTACTTTCCGT : 120
TrCHSg2 : AACAACAAAGGTGCCCGTGTGTTGGTGGTTTGTTCAGAGATAACTGCAGTTACTTTCCGT : 115
TrCHSg3 : AACNACAAAGGTGCCCGTGTGTTGGTGGTTTGTTCAGAGATAACTGCAGTTACTTTCCGT : 111

*        140         *        160         *        180
TrCHSg1 : GGACCCAGTGACACTCATCTTGATAGCCTTGTGGGCAAGCATTGTTTGGAGATGGTGCA : 180
TrCHSg2 : GGACCCAGTGACACTCACCTTGATAGCCTTGTGGGCAAGCATTGTTTGGAGATGGTGCA : 175
TrCHSg3 : GGACCCAGTGACACTCACCTTGATAGCCTTGTGGGCAAGCATTGTTTGGAGATGGTGCA : 171

*        200         *        220         *        240
TrCHSg1 : GCAGCTGTGATTGTTGGTTCAGACCCTTTGCCAGAAGTTGAGAAGCCTTTGTTTGAATTG : 240
TrCHSg2 : GCAGCTGTGATTGTTGGTTCAGACCCTTTGCCAGAAGTTGAGAAGCCTTTGTTTGAATTG : 235
TrCHSg3 : GCAGCTGTGATTGTTGGTTCAGACCCTTTGCCAGAAGTTGAGAAGCCTTTGTTTGAATTG : 231

*        260         *        280         *        300
TrCHSg1 : GTATGGACCGCACAAACAATCGCTCCAGATAGTGAAGGAGCCATTGATGGTCACCTTCGC : 300
TrCHSg2 : GTATGGACCGCACAAACAATCGCTCCAGATAGTGAAGGAGCCATTGATGGTCACCTTCGC : 295
TrCHSg3 : GTATGGACCGCACAAACAATCGCTCCAGATAGTGAAGGAGCCATTGATGGTCACCTTCGC : 291

*        320         *        340         *        360
TrCHSg1 : GAAGCAGGGCTGACATTCCATCTCCTCAAGGATGTTCCTAGCCTTGTCTCAAATAACATT : 360
TrCHSg2 : GAAGCAGGGCTGACATTCCATCTCCTCAAGGATGTTCCTAGCCTTGTCTCAAATAACATT : 355
TrCHSg3 : GAAGCAGGGCTGACATTCCATCTCCTCAAGGATGTTCCTAGCCTTGTCTCAAATAACATT : 351

*        380         *        400         *        420
TrCHSg1 : GAGAAAGCGCTTGTTGATGCCTTTCAACCTTTGAATATTNTCGANTACAATTCCATCTTT : 420
TrCHSg2 : GAGAAAGCGCTTGTTGATGCCTTTCAACCTTTGAATATTTCTGACTACAATTCCATCTTT : 415
TrCHSg3 : GAGAAAGCGCTTGTTGATGCCTTTCAACCTTTGAATATTTCTGACTACAATTCCATCTTT : 411

*        440         *        460         *        480
TrCHSg1 : TGGATTGCACACCCAGGCGGACCAGCAATTCTTGACCAAGTTGAAGCTAAGTTAGGCTTA : 480
TrCHSg2 : TGGATTGCACACCCAGGCGGACCAGCAATTCTTGACCAAGTTGAAGCTAAGTTAGGCTTA : 475
TrCHSg3 : TGGATTGCACACCCAGGCGGACCAGCAATTCTTGACCAAGTTGAAGCTAAGTTAGGCTTA : 471

*        500         *        520         *        540
TrCHSg1 : AAGCCAGAGAAAATGCAANCCACTCGACATGTACTTAGCGAATATGGTAACATGTCAAGT : 540
TrCHSg2 : AAGCCAGAGAAAATGCAAGCCACTCGACATGTACTTAGCGAATATGGTAACATGTCAAGT : 535
TrCHSg3 : AAGCCAGAGAAAATGCAAGCCACTCGACATGTACTTAGCGAATATGGTAACATGTCAAGT : 531
```

FIGURE 33

```
              *         560         *         580         *         600
TrCHSg1 : GCGTGTGTGTTATTTATCTTGGATGAGATGAGGAGGAAGTCAAAAGAAGACGGACTTGCC   : 600
TrCHSg2 : GCGTGTGTGTTATTTATCTTGGATGANATGAGGAGGAAGTCAAAAGAAGACNGNCT----   : 591
TrCHSg3 : GCGTGTGTGTTATTTATCTTGGATGAGATGAGGAGGAAGTCAAAAGAAGACGGACTTGC-   : 590

TrCHSg1 : ACAACAG : 607
TrCHSg2 : ------- :  -
TrCHSg3 : ------- :  -
```

FIGURE 33 (cont)

```
             *        20         *        40         *        60
TrCHSh : AATNACACCNTNANACCTTCCAATTCTCGTACCTCACCAATCTCATTTTTATTATATATC :  60

*        80         *       100         *       120
TrCHSh : TTGGTACATCTTTTGTTACCTCCAACAAAAAAATGGTGACCGTAGAAGAGATTCGTAACG : 120

*       140         *       160         *       180
TrCHSh : CCCAACGTTCAAATGGCCCTGCCACTATCTTAGCTTTTGGCACAGCCACTCCTTCTAACT : 180

*       200         *       220         *       240
TrCHSh : GTGTCACTCAAGCTGATTATCCTGATTACTACTTTCGTATCACCAACAGCGAACATATGA : 240

*       260         *       280         *       300
TrCHSh : CTGATCTTAAGGAAAAATTCAAGCGGATGTGTGATAGATCAATGATAAAGAAACGTTACA : 300

*       320         *       340         *       360
TrCHSh : TGCACCTAACAGAAGACTTTCTGAAGGAGAATCCAAATATGTGTGAATACATGGCACCAT : 360

*       380         *       400         *       420
TrCHSh : CACTAGATGTAAGACGAGACATAGTGGTTGTTGAAGNACCAAAGCTAGGTAAAGAANCAC : 420

*       440         *  '    460         *       480
TrCHSh : CAAAAAAAGCCATATGNGAATGGGGACAACCAAAATCNAAAATCACACATGCTTGGTTTC : 480

*       500         *
TrCHSh : TGACCACTTCCGGTGNTGACATGCCCGGGG : 510
```

FIGURE 34

```
              *        20         *        40         *        60
TrCHSh : MVTVEEIRNAQRSNGPATILAFGTATPSNCVTQADYPDYYFRITNSEHMTDLKEKFKRMC :  60

*        80         *       100         *       120
TrCHSh : DRSMIKKRYMHLTEDFLKENPNMCEYMAPSLDVRRDIVVVEXPKLGKEPKKAIXEWGQPK : 120

*
TrCHSh : XKITHAWFLTTSGDMPG : 137
```

FIGURE 35

```
                  *         20         *         40         *         60
TrCHRa : GACAAATGCNTGTGGTTGGAATGGGATCCGCACCTGATTTTACATGTAAGAAAGACACAA :  60

*         80         *        100         *        120
TrCHRa : AAGATGCAATCGTTGAAGCCATCAAACAAGGTTATAGACACTTTGATACTGCTGCTGCTT : 120

*        140         *        160         *        180
TrCHRa : ATGGCTCANAACAAGCTCTTGGTGAAGGTTTGAAAGAAGCANTTGAACTTGGTCTTGTCA : 180

*        200         *        220         *        240
TrCHRa : CTANAGAAGAGCTNTTTGTTACTTCTAAACTTTGGGNNACTGAAAATCATNCTAACCTTG : 240
```

FIGURE 36

```
                *        20         *        40         *        60
TrCHRa : QMXVVGMGSAPDFTCKKDTKDAIVEAIKQGYRHFDTAAAYGSXQALGEGLKEAXELGLVT : 60

*
TrCHRa : XEEXFVTSKLWXTENHXNL : 79
```

FIGURE 37

```
                    *        20         *        40         *        60
TrCHRb : GTGTAGCAGAGTNAGAAAAAGAGAGAAAAAAAAAACATGGCAGGAAAGAAAATCCCAGAAG :  60

*        80         *       100         *       120
TrCHRb : TGTTATTGAATTCAGGACACAAAATGCCAGTCATAGGAATGGGAACATCAGTAGACAATC : 120

*       140         *       160         *       180
TrCHRb : GTCCATCAAATGATGTTCTTGCTTCAATCTTTGTTGATGCAATTGAAGTTGGTTATCGCC : 180

*       200         *       220         *       240
TrCHRb : ATTTCGATTCTGCTTCTGTGTATGGAACAGAGGAAGCCATAGGAATTGCTTTAGCAAAAG : 240

*       260         *       280         *       300
TrCHRb : CTTTAGAAAAAGGGCTTATTAAGAGTAGAGATGAAGTTTTCATCACTTCAAAGCCATGGA : 300

*       320         *       340         *       360
TrCHRb : ATACTGATGCAGATTATGAACTTATTGTTCCAGCTCTCAAGACCACATTGAAAAAGCTGG : 360

*       380         *       400         *       420
TrCHRb : GGACGGAGTATGTGGATCTTTATCTGATCCATTGGCCAGTGAGACTTAGACATGATCTTG : 420

*       440         *       460         *       480
TrCHRb : AAAACCCTGTTGTTTTCACCAAAGAAGATTTACTTCCCTTTGATATAGAAGGGACATGGA : 480

*       500         *       520         *       540
TrCHRb : AAGCTATGGAAGAATGTTATAAGTTAGGCTTAGCAAAGTCTATTGGTATATGCAATTATG : 540

*       560         *       580         *       600
TrCHRb : GTACCAAAAAACTCACCAAACTCTTGGAAACAGCCACCATTACCCCTGCAGTCAATCAGG : 600

TrCHRb : TGGA : 604
```

FIGURE 38

```
              *        20         *        40         *        60
TrCHRb : MAGKKIPEVLLNSGHKMPVIGMGTSVDNRPSNDVLASIFVDAIEVGYRHFDSASVYGTEE :  60

*        80         *       100         *       120
TrCHRb : AIGIALAKALEKGLIKSRDEVFITSKPWNTDADYELIVPALKTTLKKLGTEYVDLYLIHW : 120

*       140         *       160         *       180
TrCHRb : PVRLRHDLENPVVFTKEDLLPFDIEGTWKAMEECYKLGLAKSIGICNYGTKKLTKLLETA : 180

TrCHRb : TITPAVNQV : 189
```

FIGURE 39

```
                  *         20         *         40         *         60
TrCHRb1 : GTGTAGCAGNATTAGANAAANATATAAAAAAAAACATGGCAGGAAAGAAAATCCCAGAAG :  60
TrCHRb2 : --GTAGCAGNGTTAGNANAAGNGNGAAAAAAAAACATGGCAGGAAAGAAAATCCCAGAAG :  58
TrCHRb3 : --------AGTNNGAAAAAGAGAGAAAAAAAAAACNTGGCAGGAAACAAAATCCCAGAAG :  51
TrCHRb4 : --------AGTNNGAAAAAGAGAGAAAAAAAAAACNTGGCAGGAAAGAAAATCCCAGAAG :  51
TrCHRb5 : --------------------------------ACATGGCAGGAAAGAAAATCCCAGAAG :  27

*         80         *        100         *        120
TrCHRb1 : TGTTATTGAATTCAGGACACAAAATGCCAGTCATAGGAATGGGAACATCAGTAGACAATC : 120
TrCHRb2 : TGTTATTGAATTCAGGACACAAAATGCCAGTCATAGGAATGGGAACATCAGTAGACAATC : 118
TrCHRb3 : TGTTATTGAATTCAGGACACAAAATGCCAGTCATAGGAATGGGAACATCAGTAGACAATC : 111
TrCHRb4 : TGTTATTGAATTCAGGACACAAAATGCCAGTCATAGGAATGGGAACATCAGTAGACAATC : 111
TrCHRb5 : TGTTATTGAATTCAGGACACAAAATGCCAGTCATAGGAATGGGAACATCAGTAGACAATC :  87

*        140         *        160         *        180
TrCHRb1 : GTCCATCAAATGATGTTCTTGCTTCAATCTTTGTTGATGCAATTGAAGTTGGTTATCGCC : 180
TrCHRb2 : GTCCATCAAATGATGTTCTTGCTTCAATCTTTGTTGATGCAATTGAAGTTGGTTATCGCC : 178
TrCHRb3 : GTCCATCAAATGATGTTCTTGCTTCAATCTTTGTTGATGCAATTGAAGTTGGTTATCGCC : 171
TrCHRb4 : GTCCATCAAATGATGTTCTTGCTTCAATCTTTGTTGATGCAATTGAAGTTGGTTATCGCC : 171
TrCHRb5 : GTCCATCAAATGATGTTCTTGCTTCAATCTTTGTTGATGCAATTGAAGTTGGTTATCGTC : 147

*        200         *        220         *        240
TrCHRb1 : ATTTCGATTCTGCTTCTGTGTATGGAACAGAGGAAGCCATAGGAATTGCTTTAGCAAAAG : 240
TrCHRb2 : ATTTCGATTCTGCTTCTGTGTATGGAACAGAGGAAGCCATAGGAATTGCTTTAGCAAAAG : 238
TrCHRb3 : ATTTCGATTCTCCTTCTGTGTATGGAACAGAGGAAGCCATAGGAATTGCTTTAGCAAAAG : 231
TrCHRb4 : ATTTCGATTCTGCTTCTGTGTATGGAACAGAGGAAGCCATAGGAATTGCTTTAGCAAAAG : 231
TrCHRb5 : ATTTCGATTCTCCTTCTGTNTATGGAACAGAGGAAGCNATAGGAATTGCTTTAGCAAAAG : 207

*        260         *        280         *        300
TrCHRb1 : CTTTANAAAAGGGCTTATTAAGAGTANAGATGAAGNTTTNATCACTTGNAAGNCATGGA  : 300
TrCHRb2 : CTTTAGAAAAGGGCTTATTAAGAGTAGAGATGAAGTTTTCATCACTTCAAAGCCATGGA  : 298
TrCHRb3 : CTTTAGAAAAGGGCTTATTAAGAGTAGAGATGAAGTTTTCATCACTTCAAAGCCATGGA  : 291
TrCHRb4 : CTTTAGAAAAGGGCTTATTAAGAGTAGAGATGAAGTTTTCATCACTTCAAAGCCATGGA  : 291
TrCHRb5 : CTTTAGAAAAGGGCTTATTAAGAGTAGAGATGAAGTTTTCATCACTTCAAAGCCATGGA  : 267

*        320         *        340         *        360
TrCHRb1 : ATACTGATGCAGATTATGAACTTATTGNTNCAAN--------------------------  : 334
TrCHRb2 : ATACTGATGCAGATTATGAACTTATTGTTCCAGCTCTCAAGACCACATTGAAAAAGCTGG  : 358
TrCHRb3 : ATACTGATGCAGATTATGAACTTATTGTTCCAGCTCTCAAGACCACATTGAAAAAGCTGG  : 351
TrCHRb4 : ATACTGATGCAGATTATGAACTTATTGTTCCAGCTCTCAAGACCACATTGAAAAAGCTGG  : 351
TrCHRb5 : ATACTGATGCAGATTATGATCTTATTGNTCCAGCTCTCAAGACCACATTGAAAAAGCTGG  : 327

*        380         *        400         *        420
TrCHRb1 : ------------------------------------------------------------ :   -
TrCHRb2 : GGACGGAGTATGTGGATCTTTATCTGATCCATTGGCCAGTGAGACTTAGACATGATCTTG  : 418
TrCHRb3 : GGACGGAGTATGTGGATCTTTATCTGATCCATTGGCCAGTGAGACTTAGACATGATCTTG  : 411
TrCHRb4 : GGACGGAGTATGTGGATCTTTATCTGATCCATTGGCCAGTGAGACTTAGACATGATCTTG  : 411
TrCHRb5 : GGACAGA----------------------------------------------------- : 334
```

FIGURE 40

```
            *         440         *         460         *         480
TrCHRb1 : ------------------------------------------------------------ : -
TrCHRb2 : AAAACCCTGTTGTTTTCACCAAAGAAGATTTACTTCCCTTTGATATAGAAGGGACATGGA : 478
TrCHRb3 : AAAACCCTGTTGTTTTCACCAAACAAGATTTACTTCCCTTTGATATAGAACGGACATGGA : 471
TrCHRb4 : AAAACCCTGTTGTTTTCACCAAAGAAGATTTACTTCCCTTTGATATAGAAGGGACATGGA : 471
TrCHRb5 : ------------------------------------------------------------ : -

*         500         *         520         *         540
TrCHRb1 : ------------------------------------------------------------ : -
TrCHRb2 : AAGCTATGGAAGAATGTTATAAGTTAGGCTTAGCAAAGTCTATTGGTATATGCAATTATG : 538
TrCHRb3 : AAGCTATGGAAGAATGTTATAAGTTAGGCTTAGCAAAGTCTATTGGTATATGCAATTATG : 531
TrCHRb4 : AAGCTATGGAAGAATGTTATAAGTTAGGCTTAGCAAAGTCTATTGGTATATGCAATTATG : 531
TrCHRb5 : ------------------------------------------------------------ : -

*         560         *         580         *         600
TrCHRb1 : ------------------------------------------------------------ : -
TrCHRb2 : GTACCAAAAAACTCACCAAACTCTTGGAAACAGCCACCATTACCCCTGCAGTCAATCAGG : 598
TrCHRb3 : GTACCAAAAAACTCACCAAACTCTTGGAAACAGCCACCATTACCCCTGCAGTC------- : 584
TrCHRb4 : GTACCAAAAAACTCAC-------------------------------------------- : 547
TrCHRb5 : ------------------------------------------------------------ : -

TrCHRb1 : ----  : -
TrCHRb2 : TGGA  : 602
TrCHRb3 : ----  : -
TrCHRb4 : ----  : -
TrCHRb5 : ----  : -
```

FIGURE 40 (cont)

```
                  *         20         *         40         *         60
TrCHRc  :  TAAGAATGAANCAATTTTATCTNANAAAAGGNNCANGCAAGTNAGTTNNATTCAAACATA  :   60

*         80         *        100         *        120
TrCHRc  :  GNCTTAAAGTGTGTAACATATTCTTAACTTAAANNNTTTTNACCCNACAAAAAAAAACAA  :  120

*        140         *        160         *        180
TrCHRc  :  AGACAATAACATGGGTAGTGTTGAAATTCCAACAAAGGTTCTTACTAACACTTCTAGTCA  :  180

*        200         *        220         *        240
TrCHRc  :  AGTGAAAATGCCTGTGGTTGGAATGGGATCAGCTCCTGATTTCACATGTAAGAAAGATAC  :  240

*        260         *        280         *        300
TrCHRc  :  AAAAGATGCAATCATTGAAGCCATCAAACAAGGTTATAGACACTTTGATACTGCTGCTGC  :  300

*        320         *        340         *        360
TrCHRc  :  TTATGGCTCAGAACAAGCTCTTGGTGAAGGTTTGAAAGAAGCAATTGAACTTGGCCTTGT  :  360

*        380         *        400         *        420
TrCHRc  :  CACTAGAGAAGAGCTTTTTGTTACTTCTAAACTTTGGGTCACTGAAAATCATCCTCACCT  :  420

*        440         *        460         *        480
TrCHRc  :  TGTTGTTCCTGCTCTTCAAAAATCTCTCAAGACTCTTCAATTGGAGTACTTGGACTTGTA  :  480

*        500         *        520         *        540
TrCHRc  :  TTTGATCCATTGGCCACTTAGTTCTCAGCCTGGAAAGTTTTCATTTCCAATTGATGTGGC  :  540

*        560         *        580         *        600
TrCHRc  :  AGATCTCTTGCCATTTGATGTGAAGGGTGTTTGGGAATCCATGGAAGAAGGCTTGAAACT  :  600

*        620         *        640         *        660
TrCHRc  :  TGGACTCACTAAAGCTATTGGTGTTAGTAACTTCTCTGTCAAGAAACTTCAAAATCTTGT  :  660

*        680         *
TrCHRc  :  CTCAGTTGCCACCGTTCTTCCTGCGGTCAATCAG  :  694
```

FIGURE 41

```
              *         20         *         40         *         60
TrCHRc : MGSVEIPTKVLTNTSSQVKMPVVGMGSAPDFTCKKDTKDAIIEAIKQGYRHFDTAAAYGS :  60

*         80         *        100         *        120
TrCHRc : EQALGEGLKEAIELGLVTREELFVTSKLWVTENHPHLVVPALQKSLKTLQLEYLDLYLIH : 120

*        140         *        160         *        180
TrCHRc : WPLSSQPGKFSFPIDVADLLPFDVKGVWESMEEGLKLGLTKAIGVSNFSVKKLQNLVSVA : 180

TrCHRc : TVLPAVNQ : 188
```

FIGURE 42

```
              *         20         *         40         *         60
TrCHRc1  : TAAGAATGAANCAATTTTATCTTATAAAAGGTNCANGCAAGTTAGTTNCTATTAAACATA :  60
TrCHRc2  : ------------------------TCTNNNAAAAGGNNCANGCAAGTNAGTTNNTANTTNAACTA :  41
TrCHRc3  : -----------------------------------------------GNATTCAAACATA :  13
TrCHRc4  : -------------------------------------------------ATTCAAACATA :  11
TrCHRc5  : --------------------------------------------------TTCAAACATA :  10
TrCHRc6  : --------------------------------------------------TTCNAACATA :  10
TrCHRc7  : ------------------------------------------------------AACATA :   6
TrCHRc8  : ---------------------------------------------------------ACA :   3
TrCHRc9  : ----------------------------------------------------------CA :   2
TrCHRc10 : ----------------------------------------------------------CA :   2
TrCHRc11 : ----------------------------------------------------------CA :   2
TrCHRc12 : ----------------------------------------------------------CA :   2
TrCHRc13 : ------------------------------------------------------------ :   -
TrCHRc14 : ------------------------------------------------------------ :   -
TrCHRc15 : ------------------------------------------------------------ :   -
TrCHRc16 : ------------------------------------------------------------ :   -

*         80         *        100         *        130
TrCHRc1  : GNCTAAAAGTGTGTAACATATTCTTAACTTAAACNTTTTTGACCCAACAAAAAAAAACAA :120
TrCHRc2  : GNCTAAAAGTGTGNAACATATTCTTAACTTAAACNATTTTCACCCAACAAAAAAAAACAA :101
TrCHRc3  : GNCTAAAAGTGTGTAACATATTCTTAAACGATTTTNACCCAACAAAAAAAAACAA      : 73
TrCHRc4  : GNCTAAAAGTGTGTAACNTATTCTTAACTTAAAGNTTTTNACCCNACAAAAAAACAA    : 71
TrCHRc5  : GCCTCCNAGTGTGTAACATATTCTTAACTTAAAGATTTTNACCCNACNATAAAAAACAA  : 70
TrCHRc6  : GNCTCAAAGTGTGTAACATATTCTTAACTTAAAGATTTTCACCCAACAAAAAAAAACAA  : 70
TrCHRc7  : GNCTAAAAGTGTGTAAAATTCTTAACTTAAANNTTTTTGACCCAACNAAAAAAAAACAA  : 66
TrCHRc8  : NNNTAAGTGTGNAANATTCTAACNTAAACNATTTTNACCCNNAAAAAAAAAACNA      : 63
TrCHRc9  : NNANGTNAAGTGTGAANAATTTCTTAACTAAAANNTTTTNACCCNACAAAAAAAAACNA  : 62
TrCHRc10 : NNGTAAAGTGTGNCANTATTCNTAACNTAAANNTTTTTNACCCNACAAAAAAAAACNA   : 62
TrCHRc11 : NNGTNAAGTGTGNANCANATTCNCTAACTAAAANNTTTTTGACCCNACAAAAAAAAACNA : 62
TrCHRc13 : NNGNTAAAGTGTGNCANAANTTCTTNACTAAAANNTTTTTGACCCNACAAAANAAACNA  : 62
TrCHRc13 : --------GNGTGTAACATATTCTTAACTTAAANNTTTTTNACCCNACAAAAAAAAACAA : 52
TrCHRc14 : --------GNGTGTAACATATNCTTAACTTAAANNATTTTTNACCCNACAAAAAAAAACAA: 52
TrCHRc15 : --------GTGTGNANNNNTTNCTAACTAAAANNNTTTTNACCNNACAAAAAATNAANG  : 52
TrCHRc16 : --------------------NTTGTNACNAAANNNTTTTNACCNNACNAAAAAAAACNA  : 38

*        140         *        160         *        180
TrCHRc1  : AGACAATAACATGGGTAGTGTTGAAATTCCAACAAAGGTTCTTACTAACACTTCTAGTCA :180
TrCHRc2  : AGACAATAACATGGGTAGTGTTGAAATTCCAACAAAGGTTCTTACTAACACTTCTAGTCA :161
TrCHRc3  : AGACAACAACATGGGTAGTGTTGAAATTCCAACAAAGGTTCTTACTAACACTTCTAGTCA :133
TrCHRc4  : AGACAACAACATGGGTAGTGTTGAAATTCCAACAAAGGTTCTTACTAACACTTCTAGTCA :131
TrCHRc5  : AGACAACAACATGGGTAGTGTTGAAATTCCAACAAAGGTTCTTACTAACAGTTCTAGTCA :130
TrCHRc6  : AGACAACAACATGGGNAGCGTTGAAATTCCAACAAAGGTTCTTACTAACACTTCTAGTCA :130
TrCHRc7  : AGACAAAAACATGGGTAGTGTTGAAATTCCAACAAAGGTTCTTACTAACACTTCTAGTCA :126
TrCHRc8  : AGACAATAACATGGGTAGTGTTGAAATTCCAACAAAGGTTCTTACTAACAGTTCTAGTCA :123
TrCHRc9  : AGACAAAAACATGGGTAGTGTTGAAATTCCAACAAAGGTTCTTACTAACAGTTCTAGTCA :122
TrCHRc10 : AGACAATAACATGGGTNGNGNGAAATTCCAACAAAGGTTCTTACTAACACTTCTAGTCA  :122
TrCHRc11 : AGACNANAACATGGGTAGTGTTGAAATTCCAACAAAGGTTCTTACTAACAGTTCTAGTCA :122
TrCHRc12 : AGACAATAACATCGGTAGTGTTGAAATTCCAACAAAGGTTCTTACTAACACTTCTAGTCA :122
TrCHRc13 : ACACNATAACATGGGTAGTGTTGAAATTCCNACAAAGGTTCTTACTAACACTTCTAGTCA :112
TrCHRc14 : AGACAATAACATGGGTAGTGTTGAAATTCCAACAAAGGTTCTTACTAACACTTCTAGTCA :112
TrCHRc15 : ATACNNNAACATGGGTAGTGTTGAAATTCCAACAAAGGTTCTTACTAACAGTTCTAGTCA :112
TrCHRc16 : AGACNATNACATCCGTAGTGTTGAAATTCCNACAAAGGTTCTTACTAACACTTCTAGTCA : 98
```

FIGURE 43

```
                         *         200         *         220         *         240
TrCHRc1  : AGTGAAAATGCCTGTGGTTGGAATGGGATCAGCTCCTGATTTCACATGTAAGAAAGATAC :240
TrCHRc2  : AGTGAAAATGCCTGTGGTTGGAATGGGATCAGCTCCTGATTTCACATGTAAGAAAGATAC :221
TrCHRc3  : AGTGAAAATGCCTGTGGTTGGAATGGGATCAGCTCCTGATTTCACATGTAAGAAAGATAC :193
TrCHRc4  : AGTGAAAATGCCTGTGGTTGGAATGGGATCAGCTCCTGATTTCACATGTAAGAAAGATAC :191
TrCHRc5  : AGTGAAAATGCCTGTGGTTGGAATGGGATCAGCTCCTGACTTCACATGTAAGAAAGACAC :190
TrCHRc6  : AGTGAAAATGCCTGTGGTTGGAATGGGATCAGCTCCTGATTTTACATGTAAAAAAGACAC :190
TrCHRc7  : AGTGAAAATGCCTGTGGTTGGAATGGGATCAGCACCTGATTTCACATGTAAGAAAGACAC :186
TrCHRc8  : AGTGAAAATGCCTGTGGTTGGAATGGGATCAGCTCCTGATTTCACATGTAAGAAAGATAC :183
TrCHRc9  : AGTGAAAATGCCTGTGGTTGGAATGGGATCAGCACCTGATTTCACATGTAAGAAAGACAC :182
TrCHRc10 : AGTGAAAATGCCTGTGGTTGGAATGGGATCAGCTCCTGATTTCACATGTAAGAAAGATAC :182
TrCHRc11 : AGTGAAAATGCCTGTGGTTGGAATGGGATCAGCACCTGATTTCACATGTAAGAAAGACAC :182
TrCHRc12 : AGTGAAAATGCCTGTGGTTGGAATGGGATCAGCACCTGATTTCACATGTAAGAAAGACAC :182
TrCHRc13 : AGTGAAAATGCCTGTGGTTGGAATGGGATCAGCTCCTGATTTCACATGTAAGAAAGATAC :172
TrCHRc14 : AGTGAAAATGCCTGTGGTTGGAATGGGATCAGCTCCTGATTTCACATGTAAGAAAGATAC :172
TrCHRc15 : AGTGAAAATGCCTGTGGTTGGAATGGGATCAGCACCTGATTTCACATGTAAGAAAGACAC :172
TrCHRc16 : AGTGAAAATGCCTGTGGTTGGAATGGGATCAGCTCCTGATTTCACATGTAAGAAAGATAC :158

*         260         *         280         *         300
TrCHRc1  : AAAAGATGCAATCATTGAAGCCATCAAACAAGGTTATAGACACTTTGATACTGCTGCTGC :300
TrCHRc2  : AAAAGATGCAATCATTGAAGCCATCAAACAAGGTTATAGACACTTTGATACTGCTGCTGC :281
TrCHRc3  : AAAAGATGCAATCATTGAAGCCATCAAACAAGGTTATAGACACTTTGATATTGCTGCTGC :253
TrCHRc4  : AAAAGATGCAATCATTGAAGCCATCAAACAAGGTTATAGACACTTTGATATGCTGCTGC :251
TrCHRc5  : AAAAGATGCAATCATTGAAGCCATCAAACAAGCNTATAGACACTTTGAAACTGCTGCTGN :250
TrCHRc6  : AAAAGATGCAATCATTGAAGCCATCAAACAAGGTTATAGACACTTTGATACTGNTGCTGC :250
TrCHRc7  : AAAAGATGCAATCATTGAAGCCATCAAACAAGGTTATAGACACTTTGATACTGCTGCTGC :246
TrCHRc8  : AAAAGATGCAATCATTGAAGCCATCAAACAAGGTTATAGACACTTTGATACTGCTGCTGC :243
TrCHRc9  : AAAAGATGCAATCATTGAAGCCATCAAACAAGGTTATAGACACTTTGATACTGCTGCTGC :242
TrCHRc10 : AAAAGATGCAATCATTGAAGCCATCAAACAAGGTTATAGACACTTTGATACTGCTNTGC :242
TrCHRc11 : AAAAGATGCAATCATTGAAGCCATCAAACAGGGTTATAGACACTTTGATACTGCTGCTGC :242
TrCHRc12 : AAAAGATGCAATCATTGAAGCCATCAAACAAGGTTATAGACACTTTGATACTGCTGCTGC :242
TrCHRc13 : AAAAGATGCAATCATTGAAGCCATCAAACAAGGTTATAGACACTTTGATACTGCTGCTGC :232
TrCHRc14 : AAAAGATGCAATCATTGAAGCCATCAAACAAGGTTATAGACACTTTGATACTGCTGCTGC :232
TrCHRc15 : AAAAGATGCAATCATTGAAGCCATCAAACAAGGTTATAGACACTTTGATACTGCTGCTGC :232
TrCHRc16 : AAAAGATGCAATCATTGAAGCCATCAAACAAGGTTATAGACACTTTGATACTGCTGCTGC :218

*         320         *         340         *         360
TrCHRc1  : TTATGGCTCAGAACAAGCTCTTGGTGAAGGTTTGAAAGAAGCAATTGAACTTGGTCTTGT :360
TrCHRc2  : TTATGGCTCAGAACAAGCTCTTGGTGAAGGTTTGAAAGAAGCAATTGAACTTGGTCTTGT :341
TrCHRc3  : TTATGGCTCAGAACAAGCTCTTGGTGAAGGTTTGAAAGAAGCAATTGAACTTGGTCTTGT :313
TrCHRc4  : TTATGGCTCAGAACAAGCTCTTGGTGAAGGTTTGAAAGAAGCAATTGAACTTGGTCTTGT :311
TrCHRc5  : TTATGCNTCACAACAAGCTCTTCNNNNANNGTTCNATGCCCN------------------ :293
TrCHRc6  : TTATGGCTCANAACAAGCTCTTGGTGAAGGTTTGAAAGAAGCAATTGAACTTGGCCTTGT :310
TrCHRc7  : TTATGGCTCAGAACAAGCTCTTGGTGAAGGTTTGAAAGAAGCAATTGAACTTGGCCTTGT :306
TrCHRc8  : TTATGGCTCAGAACAAGCTCTTGGTGAAGGTTTGAAAGAAGCAATTGAACTTGGCCTTGT :303
TrCHRc9  : TTATGGCTCAGAACAAGCTCTTGGTGAAGGTTTGAAAGAAGCAATTGAACTTGGCCTTGT :302
TrCHRc10 : TTATGGCTCAGAACAAGCTCTTGGTGAAGGTTTGAAAGAAGCAATTGAACTTGGCCTTGT :302
TrCHRc11 : TTATGGCTCAGAACAAGCTCTTGGTGAAGGTTTGAAAGAAGCAATTGAACTTGGTCTTGT :302
TrCHRc12 : TTATGGCTCAGAACAAGCTCTTGGTGAAGGTTTGAAAGAAGCAATTGAACTTGGCCTTGT :302
TrCHRc13 : TTATGGCTCAGAACAAGCTCTTGGTGAAGGTTTGAAAGAAGCAATTGAACTTGGCCTTGT :292
TrCHRc14 : TTATGGCTCAGAACAAGCTCTTGGTGAAGGTTTGAAAGAAGCAATTGAACTTGGCCTTGT :292
TrCHRc15 : TTATGGCTCAGAACAAGCTCTTGGTGAAGGTTTGAAAGAAGCAATTGAACTTGGCCTTGT :292
TrCHRc16 : TTATGGCTCAGAACAAGCTCTTGGTGAAGGTTTGAAAGAAGCAATTGAACTTGGCCTTGT :278
```

FIGURE 43 (cont)

```
              *         380         *         400         *         420
TrCHRc1  : CACTAGAGAAGAGCTTTTTGTTGCTTCTAAACTTTGGGTCACTGAAAATCATCCTCATCT :420
TrCHRc2  : CACTAGAGAAGAGCTTTTTGTTGCTTCTAAACTTTGGGTCACTGAAAATCATCCTCATCT :401
TrCHRc3  : CACTAGAGAAGACCTTTTTGTTACTTCTAAACTTTGGGTCACTGAAAATCATCCTCACCT :373
TrCHRc4  : CACTAGAGAAGACCTTTTTGTTACTTCTAAACTTTCGGTCACTGAAAATCATCCTCACCT :371
TrCHRc5  : ------------------------------------------------------------ : -
TrCHRc6  : CACTAGAAAAGAGCTTTTTGTTACTTCTAAACTTTGGGTCACTGAAAATCATCCTCACCT :370
TrCHRc7  : CACTAGAGAAGAGCTTTTTGTTACTTCTAAACTTTGGGTCACTGAAAATCATCCTCACCT :366
TrCHRc8  : CACTAGAGAAGAGCTTTTTGTTACTTCTAAACTTTGGGTCACTGAAAATCATCCTCATCT :363
TrCHRc9  : CACTAGAGAAGAGCTTTTTGTTACTTCTAAACTTTGGGTCACTGAAAATCATCCTCACCT :362
TrCHRc10: CACTAGAGAAGAGCTTTTTGTTACTTCTAAACTTTGGGTCACTGAAAATCATCCTCACCT :362
TrCHRc11: CACTAGAGAAGACCTTTTTGTTACTTCTAAACTTTGGGTCACTGAAAATCATCCTCATCT :362
TrCHRc12: CACTAGAGAAGAGCTTTTTGTTACTTCTAAACTTTGGGTCACTGAAAATCATCCTCACCT :362
TrCHRc13: CACTAGAGAAGAGCTTTTTGTTACTTCTAAACTTTGGGTCACTGAAAATCATCCTCACCT :352
TrCHRc14: CACTAGAGAAGAGCTTTTTGTTACTTCTAAACTTTGGGTCACTGAAAATCATCCTCACCT :352
TrCHRc15: CACTAGAGAAGAGCTTTTTGTTACTTCTAAACTTTGGGTCACTGAAAATCATCCTCACCT :352
TrCHRc16: CACTAGAGAAGAGCTTTTTGTTACTTCTAAACTTTGGGTCACTGAAAATCATCCTCACCT :338

*         440         *         460         *         480
TrCHRc1  : TGTTGTTCCTGCTCTTCAAAAATCTCTCAAGACTCTTCAATTGGAGTACTTGGACTTGTA :480
TrCHRc2  : TGTTGTTCCTGCTCTTCAAAAATCTCTCAAGACTCTTCAATTGGAGTACTTGGACTTGTA :461
TrCHRc3  : TGTTATTCCTGCTCTTCAAAAATCTCTCAAGACTCTTCAATTGGAGTACTTGGACTTGTA :433
TrCHRc4  : TGTTATTCCTGCTCTTCAAAAATCTCTCAAGACTCTTCAATTGGAGTACTTGGACTTGTA :431
TrCHRc5  : ------------------------------------------------------------ : -
TrCHRc6  : TGTTGTTCCTGCTCTTCAAAAATCTCTCAAGACTCTTCAATTGGAGTACTTGGACTTGTA :430
TrCHRc7  : TGTTGTTCCTGCTCTTCAAAAATCTCTCAAGACTCTTCAATTGGAGTACTTGGACTTGTA :426
TrCHRc8  : TGTTGTTCCTGCTCTTCAAAAATCTCTCAAGACTCTTCAATTGGAGTACTTGGACTTGTA :423
TrCHRc9  : TGTTGTTCCTGCTCTTCAAAAATCTCTCAAGACTCTTCAATTGGAGTACTTGGACTTGTA :422
TrCHRc10: TGTTATTCCTGCTCTTCAAAAATCTCTCAAGACTCTTCAATTGGAGTACTTGGACTTGTA :422
TrCHRc11: TGTTGTTCCTGCTCTTCAAAAATCTCTCAAGACTCTTCAATTGGAGTACTTGGACTTGTA :422
TrCHRc12: TGTTGTTCCTGCTCTTCAAAAATCTCTCAAGACTCTTCAATTGGAGTACTTGGACTTGTA :422
TrCHRc13: TGTTGTTCCTGCTCTTCAAAAATCTCTCAAGACTCTTCAATTGGAGTACTTGGACTTGTA :412
TrCHRc14: TGTTGTTCCTGCTCTTCAAAAATCTCTCAAGACTCTTCAATTGGAGTACTTGGACTTGTA :412
TrCHRc15: TGTTGTTCCTGCTCTTCAAAAATCTCTCAAGACTCTTCAATTGGAGTACTTGGACTTGTA :412
TrCHRc16: TGTTGTTCCTGCTCTTCAAAAATCTCTCAAGACTCTTCAATTGGAGTACTTGGACTTGTA :398

*         500         *         520         *         540
TrCHRc1  : TTTGATCCATGGCCACTTAGTTCTCAGCCGGGAAAGTTTTCATTTCCAATTGAGGTGGC :540
TrCHRc2  : TTTGATCCATGGCCACTTAGTTCTCAGCCGGGAAAGTTTTCATTTCCAATTGAGGTGGC :521
TrCHRc3  : TTTGATCCAGTGGCCACTTAGTTCTCAGCCGGGAAAGTTTTCATTTCCAATTGAGGTGGC :493
TrCHRc4  : TTTGATCCAGTGGCCACTTAGTTCTCAGCCGGGAAAGTTTTCATTTCCAATTGAGGTGGC :491
TrCHRc5  : ------------------------------------------------------------ : -
TrCHRc6  : TTTGATCCATTGGCCACTTAATTCTCANCCTGAAAGTTTTCATTTCCGATTGANGTGGC :490
TrCHRc7  : TTTGATCCATTGGCCACTTAGTTCTCAGCCTGGAAAGTTTTCATTTCCAATTGATGTGGC :486
TrCHRc8  : TTTGATCCATTGGCCACTTAGTTCTCAGCCTGGAAAGTTTTCATTTCCAATTGATGTGGC :483
TrCHRc9  : TTTGATCCATTGGCCACTTAGTTCTCAGCCTGGAAAGTTTTCATTTCCAATTGATGTGGC :482
TrCHRc10: TTTGATCCATTGGCCACTTAGTTCTCAGCCTGGAAAGTTTTCATTTCCAATTGATGTGGC :482
TrCHRc11: TTTGATCCATTGGCCACTTAGTTCTCAGCCTGGAAAGTTTTCATTTCCAATTGATGTGGC :482
TrCHRc12: TTTGATCCATTGGCCACTTAGTTCTCAGCCTGGAAAGTTTTCATTTCCAATTGATGTGGC :482
TrCHRc13: TTTGATCCATTGGCCACTTAGTTCTCAGCCTGGAAAGTTTTCATTTCCAATTGATGTGGC :472
TrCHRc14: TTTGATCCATTGGCCACTTAGTTCTCAGCCTGGAAAGTTTTCATTTCCAATTGATGTGGC :472
TrCHRc15: TTTGATCCATTGGCCACTTAGTTCTCAGCCGAAAGTTTTCATTTCCAATTGATGTGGC :472
TrCHRc16: TTTGATCCATTGGCCACTTAGTTCTCAGCCTGGAAAGTTTTCATTTCCAATTGATGTGGC :458
```

FIGURE 43 (cont)

```
                    *         560         *         580         *         600
TrCHRc1  : AGATCTCTTGCCATTTGATGTGAAGGGTGTTTGGGG----------------------- :576
TrCHRc2  : AGN-------------------------------------------------------- :524
TrCHRc3  : AGATCTCTTGCCATTTGATGTGAGGGGTGTTTGGCAATCCATGGAAGAAGGCTTGAAACT :553
TrCHRc4  : AGATCTCTTGCCATTTGATGTGAGGGGTGTTTGGCAATCCATGGAAGAAGGCTTGAAACT :551
TrCHRc5  : ------------------------------------------------------------ :  -
TrCHRc6  : AAATCTCTTGCCATTTNATGTGAANGGTGTTTGGGAATCCATGGAAAAANGCTTNAAACT :550
TrCHRc7  : AGATCTCTTGCCATTTGATGTGAAGGGTGTTTGGCAATCCATGGAAGAAGGCTTGAAACT :546
TrCHRc8  : AGATCTCTTGCCATTTGATGTGAAGGGTGTTTGGGAATCCATGGAAGAAGGCTTGAAACT :543
TrCHRc9  : AGATCTCTTGCCATTTGATGTGAACCGTGTTTGGGAATCCATGGAAGAACGCTTGAAACT :542
TrCHRc10 : AGATCTCTTGCCATTTGATGTGAAGGGTGTTTGGGAATCCATGGAAGAAGGCTTGAAACT :542
TrCHRc11 : AGATCTCTTGCCATTTGATGTGAAGGGTGTTTGGGAATCCATGGAAGAAGGCTTGAAACT :542
TrCHRc12 : AGATCTCTTGCCATTTGATGTGAAGGGTGTTTGGCAATCCATGGAAGAAGGCTTGAAACT :542
TrCHRc13 : AGATCTCTTGCCATTTGATGTGAAGGGTGTTTGGGAATCCATGGAANAAGGCTTGAAACT :532
TrCHRc14 : AGATCTCTTGCCATTTGATGTGAAGGGTGTTTGGGAATCCATGGAAGAAGGCTTGAAACT :532
TrCHRc15 : AGATCTCTTGCCATTTGATGTGAAGGGTGTTTGGGAATCCATGGAAGAAGGCTTGAAACT :532
TrCHRc16 : AGATCTCTTGCCATTTGATGTGAAGGGTGTTTGGGAATCCATGGAAGAAGGCTTGAAACT :518

*         620         *         640         *         660
TrCHRc1  : ------------------------------------------------------------ :  -
TrCHRc2  : ------------------------------------------------------------ :577
TrCHRc3  : TGGACTCACTAAAGCTATTGGTGT------------------------------------ :577
TrCHRc4  : TGGACTCACTAAAGCTATTGGTGTAGTAACTTCTCTGTCAAGAAN--------------- :597
TrCHRc5  : ------------------------------------------------------------ :  -
TrCHRc6  : TGGACTCACTAAAGCTATTGGTGNCANNAACTTCTCTNTCAANAAACTTCAAAATCTTNT :610
TrCHRc7  : TGGACTCACTAAAGCTATTGGTGT------------------------------------ :570
TrCHRc8  : TGGACTCACTAAAGCTATTGGTGTTAGTAACTTCTCTGTCAAGAAACTTCAAAATCTTGT :603
TrCHRc9  : TGGACTCACTAAAGCTATTGGTGTTAGTAAN----------------------------- :573
TrCHRc10 : TGGACTCACTAAAGCTATTGGTGTTAGTAACTTCTCTGTCD------------------- :583
TrCHRc11 : TGGACTCACTAAAGCTATTGGTGTTAGTAACTTCTCTGTCAAGAAACTTCAAAAT----- :597
TrCHRc12 : TGGACTCACTAAAGCTATTGGTGTTAGTAACTTCTCTGTCAAGAAACTTCAAAAT----- :597
TrCHRc13 : TGGACTCNCTAAAGCTATTGGTGTTANNNACTTCTNTGTNAN------------------ :574
TrCHRc14 : TGGACTCACTAAAGCTATTGGTGTTAGTAACTTCTCTGTCAAGAAN--------------- :578
TrCHRc15 : TGGACTCACTAAAGCTATTGGTGTCAGTAACTTCTCTGTCAAGAAACTTCAAAATCTTGT :592
TrCHRc16 : TGGACTCACTAAAGCTATTGGTGTTAGTAACTTCTCTGTCAAGAAACTTCAAAATCTTGT :578

*         680         *
TrCHRc1  : ----------------------------------- :  -
TrCHRc2  : ----------------------------------- :  -
TrCHRc3  : ----------------------------------- :  -
TrCHRc4  : ----------------------------------- :  -
TrCHRc5  : ----------------------------------- :  -
TrCHRc6  : CTCAATTGCCACCGTTCTTNCTGCCG--------- :636
TrCHRc7  : ----------------------------------- :  -
TrCHRc8  : CTCAGTTGCCACCGTTCT----------------- :621
TrCHRc9  : ----------------------------------- :  -
TrCHRc10 : ----------------------------------- :  -
TrCHRc11 : ----------------------------------- :  -
TrCHRc12 : ----------------------------------- :  -
TrCHRc13 : ----------------------------------- :  -
TrCHRc14 : ----------------------------------- :  -
TrCHRc15 : CTCAGTTC--------------------------- :600
TrCHRc16 : CTCAGTTGCCACCGTTCTTCCTGCGGTCAATCAG  :612
```

FIGURE 43 (cont)

```
            *         20         *         40         *         60
TrDFRa : GCACACNTTCTTGACTTACCAATTGTAATNCATAATAATTNTAAACATGTCAAAGACAGT :  60

*         80         *        100         *        120
TrDFRa : TTGTGTNACCGGAGCCAGCGGAGCCATCGGTTCATGGGTGGTTCGCCTCCTCCTCGAACG : 120

*        140         *        160         *        180
TrDFRa : CGGCTACATTGTCCACGCCACCATCCAAGATCTCGAGGATGAGAACGAGACAAAACATTT : 180

*        200         *        220         *        240
TrDFRa : GGAAGCAATGGAAGGAGCAAAGGGTCATCTCAAATTTTTCGAAATGGATCTTCTTAACAG : 240

*        260         *        280         *        300
TrDFRa : CGACTCTATTGCGGCCGCCGTGAAAGGTTGTGCCGGAGTTATACATCTTGCATGTCCTAA : 300

*        320         *        340         *        360
TrDFRa : CATCATTGGTGAAGTCAAAGACCCCGAGAAGCAAATTTTGGAACCGGCAATTCAAGGAAC : 360

*        380         *        400         *        420
TrDFRa : GGTTAATGTGTTGAAGGTGGCAAAGGAAGCAGGGGTGGAGCGTGTGGTGGCGACATCGTC : 420

*        440         *        460         *        480
TrDFRa : GATCTCCGCCATCATACCGAGTCCTAATTGGCCAGCTGATAAGATTAAGGGAGAAGATTG : 480

*        500         *        520         *        540
TrDFRa : TTGGACAGACCTTGATTATTGCAAGGAAAAGAAGTTATACTACCCCATTGCAAAGACACT : 540

*        560         *        580         *        600
TrDFRa : AGCAGAAAAAGCTGGTTGGGAATTTGCTAAAGAGACCGGTTTTGATGTTGTTATGATTAA : 600

*
TrDFRa : CCCTGGTACT : 610
```

FIGURE 44

```
                  *        20         *        40         *        60
TrDFRa : MSKTVCXTGASGAIGSWVVRLLLERGYIVHATIQDLEDENETKHLEAMEGAKGHLKFFEM :  60

*        80         *       100         *       120
TrDFRa : DLLNSDSIAAAVKGCAGVIHLACPNIIGEVKDPEKQILEPAIQGTVNVLKVAKEAGVERV : 120

*       140         *       160         *       180
TrDFRa : VATSSISAIIPSPNWPADKIKGEDCWTDLDYCKEKKLYYPIAKTLAEKAGWEFAKETGFD : 180

TrDFRa : VVMINPGT : 188
```

FIGURE 45

```
           *        20         *        40         *        60
TrDFRa1  : GCACACCTTCTTGACTTACCAATTGTAATNCATAATAATTNTAAACATGTCAAAGACAGT :  60
TrDFRa2  : GCNCACNTTCTTGACTTACCAATTGTAATNCATAATATTTATAAACATGTCAAAGACAGT :  60
TrDFRa3  : GCACACNTTCTTGACTTACNAATTGTAATNCATAATAATTNTAAACATGTCAAAGGCAGT :  60
TrDFRa4  : GCACACNTTCTTGACTTACCAATTGTAATNCATAATAATTNTAAACATGTCAAAGACAGT :  60
TrDFRa5  : --GCCNCTTCTTGACNCACNAATTGTAATNCATAATAATTATAAACATGTNNAAGACAGT :  58
TrDFRa6  : --GCTNCTTCTTGACTTACNAATTGTAATNCATAATAATTNTAAACATGTNAAAGACAGT :  58
TrDFRa7  : -----CNTTCTTGACNTACCAATTGTAATNCATAATAATTNTAAACATGTCNAAGGCAGT :  55
TrDFRa8  : -----CNTTCTTGACTTACNAATTGTAATNCATAATATTTATAAACATGTCAAAGACAGT :  55
TrDFRa9  : ------NTTCTTGACNTACCCATTNTNATNCATAATNATTNNNAACNTGTNAAAGACAGT :  54
TrDFRa10 : --------------------------------------------------NGNGT    :   5

*        80         *       100         *       120
TrDFRa1  : TTGTGTNACCGGAGCCAGCGGAGCCATCGGTTCATGGGTGGTTCGCCTCCTCCTCGAACG :120
TrDFRa2  : TTGTGTNACCGGAGCCAGCGGAGCCATCGGTTCATGGGTGGTTCGCCTCCTCCTGGAACG :120
TrDFRa3  : TTGTGTNACCGGAGCCAGCGGAGCCATNGGTTCATGGGTGGTTCGCCTCCTCCTCAACG  :120
TrDFRa4  : TTGTGTNACCGGAGCCAGCGGAGCCATCGGTTCATGGGTGGTTCGCCTCCTCCTCGAACG :120
TrDFRa5  : TTGTGTNACNGGAGCCAGCGGAGCCATCGGTTCATGGGTGGTTCGCCTCCTCCTCGAACG :118
TrDFRa6  : TTGTGTNACCGGAGCCAGCGGAGCCATCGGTTCATGGGTGGTTCGCCTCCTCCTCGAACG :118
TrDFRa7  : TTGTGTNNCCGGAGCCNGCGGAGCCATNGGTTCATGGGTGGTTCGCCTCCTCCTCGAACG :115
TrDFRa8  : TTGTGTNACCGGAGCCAGCGGAGCCATCGGTTCATGGGTGGTTCGNCTCCTCCTGGAACG :115
TrDFRa9  : TTGTGTNACCGGAGCCNGCGGAGCCATCGGTTCATGGGTGGTTCGCCTCCTCCTCGAACG :114
TrDFRa10 : TTGTGTNANCNGAGCNNGCGGAGCCNTCGGTTANTGGGTGGTTCGCCTCCTCCTNCNACG : 65

*       140         *       160         *       180
TrDFRa1  : CGGCTACATTGTCCACGCCACCATCCAAGATCTCGAGGATGAGAACGAGACAAAACATTT :180
TrDFRa2  : CGGCTACATNGTCCACGCCACCATCCAAGATCTCGAGGATGAGAACGAGACAAAACATTT :180
TrDFRa3  : CGGCTACATTGTCCACGCCACCATCCAAGATCTCGAGGATGAGAACGAGACAAAACATTT :180
TrDFRa4  : CGGCTACATTGTCCACGCCACCATCCAAGATCTCGAGGATGAGAACGAGACAAAACATTT :180
TrDFRa5  : CGGCTACATTGTCCACGCCACCATCCAAGATCTCGAGGATGAGAACGAGACAAAACATTT :178
TrDFRa6  : CGGCTACATTGTCCACGCCACCATCCAAGATCTCGAGGATGAGAACGAGACAAAACATTT :178
TrDFRa7  : CGGCTACATTGTCCACGCCACCATCCAAGATCTCGAGGATGAGAACGAGACAAAACATTT :175
TrDFRa8  : CGGCTACATNGTCCACGCCACCATCCAAGATCTCGAGGATGAGAACGAGACAAAACATTT :175
TrDFRa9  : CGGCTACATTGTCCACGCCACCATCCAAGATCTCGAGGATGAGAACGAGACAAAACATTT :174
TrDFRa10 : CGGNTACATTGTCCACGCCACCATCCAAGATCTCGAGGATGAGAACGAGACAAAACATTT :125

*       200         *       220         *       240
TrDFRa1  : GGAAGCAATGGAAGGAGCAAAGGGTCATCTCAAATTTTTCGAAATGGATCTTCTTAACAG :240
TrDFRa2  : GGAAGCAATGGAAGCGGCAAAGGGTCATCTNAAATTTTTCGAAATGGATCTTCTTAACAG :240
TrDFRa3  : GGAAGCAATGGAAGGAGCAAAGGGTCATCTCAAATTTTTNGAAATGGATCTTCTTAACAG :240
TrDFRa4  : GGAAGCAATGGAAGGAGCAAAGGGTCATCTCAAATTTTTCGAAATGGATCTTCTNAACAG :240
TrDFRa5  : GGAAGCAATGGAAGGAGCAAAGGGTCATCTCAAATTTTTCGAAATGGATCTTCTTAACAG :238
TrDFRa6  : GGAAGCAATGGAAGGAGCAAAGGGTCATCTCAAATTTTTCGAAATGGATCTTCTNAACAG :238
TrDFRa7  : GGAAGCAATGGAAGGAGCAAAGGGTCATCTCAAATTTTTNGAAATGGATCTTCTTAACAG :235
TrDFRa8  : GGAAGCAATGGAAGGGGCAAAGGGTNATCTNAAATTTTTCGAAATGGATCTTCTTAACAG :235
TrDFRa9  : GGAAGCAATGGAAGGAGCAAAGGGTCATCTCAAATTTTTNGAAATGGATCTTCTTAACAG :234
TrDFRa10 : GGAAGCAATGGAAGGAGCAAAGGGTCATNTNAAATTTTTCGAAATGGATCTTNTTAACAG :185
```

FIGURE 46

```
              *         260         *         280         *         300
TrDFRa1  : CGACTCTATTGCGGNCGCCGTGAAAGGTTGNGCCGGAGTTATACATNTTGNCTGTCCTAC :300
TrDFRa2  : TGACTCTATTGCGGCCGCCGTGAAAGGTTGTGCCGGAGTTATACATNTTGCATGTGCTAA :300
TrDFRa3  : CGACTCTATTGCGGCCGCCGTGAAAGGTTGTGCCGGAGTTATACATCTTGCATGTCCTAA :300
TrDFRa4  : CGACTCTATTGCGGCCGCCGTGAAAGGTTGTGCCGGAGTTATACATCTTGCATGTCCTAG :300
TrDFRa5  : CGACTCTATTGCGGCCGCCGTGAAAGGTTGTGCCGGAGTTATACATCTTGCATGTCCTAA :298
TrDFRa6  : CGACTCTATTGCGGCCGCCGTGAAAGGTTGTGCCGGAGTTATACATCTTGCATGTCCTAG :298
TrDFRa7  : CGACTCTATTGCGGCCGCCGTGAAAGGTTGTGCCGGAGTTATACATCTTGCATGTCCTAA :295
TrDFRa8  : TGACTCTATTGCGGCCGCCGTGAAAGGTTGTGCCGGAGTTATACATCTTGCATGTCCTAA :295
TrDFRa9  : CGACTCTATTGCGGNCGCCGTGAAAGGTTGTGCCGGAGTTATACATCTTGCATGNGCTAA :294
TrDFRa10 : NGACTCTATTGCGGCCGCCGTGAAAGGTTGTGCCGGAGTTATACATN------------ :232

*         320         *         340         *         360
TrDFRa1  : CCCCGTTGGCGANGACNNNGCACCCNN--------------------------------- :327
TrDFRa2  : CATCATTGCTGAANGNAAANACCNCGANAACGNGATTTTCNAACCNGNN----------- :349
TrDFRa3  : CATCATTGGTGAAGTCAAAGACCCCGAGAAGCAAATTTTGGAACCGGCAATTCAAGGAAC :360
TrDFRa4  : CATCATTGGTGAAGTCAAAGACCCCGAGAAGCAAATTTTGGAACCGGCAATTCAAGGAAC :360
TrDFRa5  : CATCATTGGTGAAGTCAAAGACCCCGAGAAGCAAATTTTGGAACCGGCAATTCAAGGAAC :358
TrDFRa6  : CATCATTGGTGAAGTCAAAGACCCCGAGAAGCAAATTTTGGAACCGGCAATTCAAGGAAC :358
TrDFRa7  : CATCATTGGTGAAGTCAAAGACCCCGAGAAGCAAATTTTGGAACCGGCAATTCAAGGAAC :355
TrDFRa8  : CATCATTGGTGAAGTCAAAGACCCCGAGAAGCAAATTTTGGAACCGGCAATTCAAGGAAC :355
TrDFRa9  : CATCATTGGGGAAGCNAAAGNACNCNATAAGNAN-------------------------- :328
TrDFRa10 : ------------------------------------------------------------ :  -

*         380         *         400         *         420
TrDFRa1  : ------------------------------------------------------------ :  -
TrDFRa2  : ------------------------------------------------------------ :  -
TrDFRa3  : GGTTAATGTGTTGAAGGTGGCAAAGGAAGCAGGGGTGGAGCGTGTGGTGGCGACATCGTC :420
TrDFRa4  : GGTTAATGTGTTGAAGGTGGCAAAGGAAGCAGGGGTGGAGCGTGTGGTGGCGACATCGTC :420
TrDFRa5  : CGTTAATGTGTTGAAGGTGGCAAAGGAAGCAGGGGTGGAGCGTGTGGTGGCGACATCGTC :418
TrDFRa6  : GGTTAATGTGTTGAAGGTGGCAAAGGAAGCAGGGGTGGAGCGTGTGGTGGCGACATCGTC :418
TrDFRa7  : GGTTAATGTGTTGAAGGTGGCAAAGGAAGCAGGGGTGGAGCGTGTGGTGGCGACATCGTC :415
TrDFRa8  : GGTTAACGTGTTGAAGGTGGCAAAGGAAGCAGGGGTGGAGCGTGTGGTGGCGACGTCATC :415
TrDFRa9  : ------------------------------------------------------------ :  -
TrDFRa10 : ------------------------------------------------------------ :  -

*         440         *         460         *         480
TrDFRa1  : ------------------------------------------------------------ :  -
TrDFRa2  : ------------------------------------------------------------ :  -
TrDFRa3  : GATCTCCGCCATCATACCGAGTCCTAATTGGCCAGCTGATAAGATTAAGGGAGAAGATTG :480
TrDFRa4  : GATCTCCGCCATCATACCGAGTCCTAATTGGCCAGCTGATAAGATTAAGGGAGAAGATTG :480
TrDFRa5  : GATCTCTGCCATCATACCGAGTCCTAATTGGCCAGCTGATAAGATTAAGGGAGAAGATTG :478
TrDFRa6  : GATCTCCGCCATCATACCGAGTCCTAATTGGCCAGCTGATAAGATTAAGGGAGAAGATTG :478
TrDFRa7  : GATCTCCGCCATCATACCGAGTCCTAATTGGCCAGCTGATAAGATTAAGGGAGAAGATTG :475
TrDFRa8  : GATCTCCGCCATCATACCGAGTCCTAATTGGCCAGCTGATAAGATTAAGGGAGAAGATTG :475
TrDFRa9  : ------------------------------------------------------------ :  -
TrDFRa10 : ------------------------------------------------------------ :  -
```

FIGURE 46 (cont)

```
                          *       500         *        520         *         540
TrDFRa1  : ------------------------------------------------------------ :   -
TrDFRa2  : ------------------------------------------------------------ :   -
TrDFRa3  : NTGGACAGACCTTGATTATTGCAANGAAAAGAAGTTATACTACCCCATTGCAAAGACATT :540
TrDFRa4  : TTGGACAGACCTTGATTATTGCAAGGAAAAGAAGTTATACTACCCCATTGCAAAGACACT :540
TrDFRa5  : TTGGACAGACCTTGATTATTGCAAGGAAAAGAAGTTATACTACCCCATTGCAAAGACACT :538
TrDFRa6  : TTGGACAGACCTTGATTATTGCAAGGAAAAGAAGTTATACTACCCCATTGCAAAGACACT :538
TrDFRa7  : TTGGACAGACCTTGATTATTGCAAGGAAAAGAAGTTATACTACCCCATTGCAAAGACATT :535
TrDFRa8  : TTGGACGGACCTTGATTATTGCAAGGAAAAGAAGTTACACTACCCCATCGCAAAGACACT :535
TrDFRa9  : ------------------------------------------------------------ :   -
TrDFRa10 : ------------------------------------------------------------ :   -

*       560         *        580         *         600
TrDFRa1  : ------------------------------------------------------------ :   -
TrDFRa2  : ------------------------------------------------------------ :   -
TrDFRa3  : ANCAGAAAAAGCTGGTTGGGAATTTGCTAAAGAGACCGGTTTTGATGTTGTT--------  :592
TrDFRa4  : AGCAGAAAAAGCTGGTTGGGAATTTGCTAAAGAGACCGGTTTTGATGTTGTTAT------  :594
TrDFRa5  : AGCAGAAAAAGCTGGTTGGGAATTTGCTAGAGAGACCGGTTTTGT---------------  :583
TrDFRa6  : AGCAGAAAAAGCTGGTTGGGAATTTGCTAAAGAGACCGGTTTTGATGTTGTTATGATTAA  :598
TrDFRa7  : ANCAGAAAAAGCTGGTTGGGAATTTGCTAAAGAGAC------------------------  :571
TrDFRa8  : AGCAGAAAAAGCTGGTTGGGAATTTGCTAAAGAGACCGGTTTTGATGTTGT---------  :586
TrDFRa9  : ------------------------------------------------------------ :   -
TrDFRa10 : ------------------------------------------------------------ :   -

*
TrDFRa1  : ----------  :   -
TrDFRa2  : ----------  :   -
TrDFRa3  : ----------  :   -
TrDFRa4  : ----------  :   -
TrDFRa5  : ----------  :   -
TrDFRa6  : CCCTGGTACT  : 608
TrDFRa7  : ----------  :   -
TrDFRa8  : ----------  :   -
TrDFRa9  : ----------  :   -
TrDFRa10 : ----------  :   -
```

FIGURE 46 (cont)

```
                    *         20         *         40         *         60
TrDFRb : ATAAAACCAANCTNCAAAACTGATTGGAACTCAGAAAAATAGAAGAAAAGAGATGCCTGA :  60

*         80         *        100         *        120
TrDFRb : GTTTTGTGTTACAGGGGGCACTGGCTTCATAGCAGCCTACCTAGTGAAAGCCTTATTAGA : 120

*        140         *        160         *        180
TrDFRb : AAAGGGTCACACAGTAAGGACTACTGTAAGAAACCCAGATGATTTGGAGAAGGTTGGTTA : 180

*        200         *        220         *        240
TrDFRb : TCTAACTGAACTAAGTGAAGACAAAGAGAGATTGAAGATTTTAAAAGCAGATCTATTGGT : 240

*        260         *        280         *        300
TrDFRb : GGAAGGGAGTTTTGATGAGGCAGTGAGTGGTGTTGATGGTGTGTTTCATACAGCTTCCCC : 300

*        320         *        340         *        360
TrDFRb : TGTTCTTGTTCCACATGATGACAACATTCAGGTTACTTTGATTGATCCATGTATAAAGG : 360

*        380         *        400         *        420
TrDFRb : AACACAAAATGTGCTTAACTCATGCATCAAAGCAAAGGTGAAACGTGTGGTGTTAACATC : 420

*        440         *        460         *        480
TrDFRb : TTCATGCTCTTCCATAAGATACCGTGACGATGTGCAACAAATTTCTCCTCTTAATGAATC : 480

*        500         *        520         *        540
TrDFRb : TCATTGGAGTGATTCTGAATACTGCAAACGCTATAACCTGTGGTATGCATATGCAAAGAC : 540

*        560         *        580         *        600
TrDFRb : TTTAGGAGAAAAAGAAGCATGGAGGATTGCAAAGGAAAGTGGAATTGATCTAGTTGTAGT : 600

*        620
TrDFRb : TAACCCCTCTTTTGTTGGTGGTC : 623
```

FIGURE 47

```
             *        20         *        40         *        60
TrDFRb : MPEFCVTGGTGFIAAYLVKALLEKGHTVRTTVRNPDDLEKVGYLTELSEDKERLKILKAD :  60

*        80         *       100         *       120
TrDFRb : LLVEGSFDEAVSGVDGVFHTASPVLVPHDDNIQVTLIDPCIKGTQNVLNSCIKAKVKRVV : 120

*       140         *       160         *       180
TrDFRb : LTSSCSSIRYRDDVQQISPLNESHWSDSEYCKRYNLWYAYAKTLGEKEAWRIAKESGIDL : 180

*
TrDFRb : VVVNPSFVGG : 190
```

FIGURE 48

```
            *         20         *         40         *         60
TrDFRb1 : ATAAAACCAANCTNCAAAACTGATTGGAACTNAGAAAAATAGAAGAAAAGAGATGCCTGA  :  60
TrDFRb2 : ---------------------------------GNACCTCNNAAAAATAGAAGAAAAGAGATGCCTGA  :  35
TrDFRb3 : --------------------------------------------------GGAAAGAGATGCCTGA  :  16
TrDFRb4 : -------------------------------------------------------GAGATGCCTGA  :  11

*         80         *        100         *        120
TrDFRb1 : GTTTTGTGTTACAGGGGGCACTGGGTTCATAGCAGCCTACCTAGTGAAAGCCTTATTAGA  : 120
TrDFRb2 : GTTTTGTGTTACAGGGGGCACTGCGTTCATAGCAGCCTACCTAGTGAAAGCCCTATTAGA  :  95
TrDFRb3 : GTTTTGTGTTACAGGGGGCACTGGCTTCATAGCAGCTTACCTAGTGAAAGCCTTATTAGA  :  76
TrDFRb4 : GTTTTGTGTTACAGGGGGCACTGGCTTCNTAGCAGCTTACCTAGTGAAAGCCTTATTAGA  :  71

*        140         *        160         *        180
TrDFRb1 : AAAGGGTCACACAGTAAGGACTACTGTAAGAAACCCAGATGATTTGGAGAAGGTTGGTTA  : 180
TrDFRb2 : AAAGGGTCACACAGTAAGGACTACTGTAAGAAACCCAGATGATTTGGAGAAGGTTGGTTA  : 155
TrDFRb3 : AAAGGGTCACACAGTAAGGACTACTGTAAGAAACCCAGATGATTTGGAGAAGGTTGGTTA  : 136
TrDFRb4 : AAAGGGTCACACAGTAAGGACTACTGTAAGAAACCCAGATGCTTTGGAGAAGGTTGGTTA  : 131

*        200         *        220         *        240
TrDFRb1 : TCTAACTGAACTAAGTGAAGACAAACAGAGATTGAAGATTTTAAAAGCAGATCTATTGGT  : 240
TrDFRb2 : TCTAACTGAACTAAGTGAAGACAAAGAGAGATTGAAGATTTTAAAAGCAGATCTATTGGT  : 215
TrDFRb3 : TCTAACTGAACTTAGTGAAGACAAAGAGAGATTGAAGATTTTAAAAGCAGATCTATTGGT  : 196
TrDFRb4 : TCTAACTGAACTTAGTGAAGACAAAGAGAGATTGAAGATTTTAAAAGCAGATCTATTGGT  : 191

*        260         *        280         *        300
TrDFRb1 : GGAAGGGAGTTTTGATGAGGCAGTGAGTGGTGTTGATGGTGTGTTTCATACAGCTTCCCC  : 300
TrDFRb2 : GGAAGGGAGTTTTGATGAGGCAGTGAGTGGTGTTGATGGTGTGTTTCATACAGCTTCCCC  : 275
TrDFRb3 : GGAAGGGAGTTTTGATGAGGCAGTGAGTGGTGTTGATGGTGTCTTTCATACAGCTTCCCC  : 256
TrDFRb4 : GGAAGGGAGTTTTGATGAGGCAGTGAGTGGTGTTGATGGTGTGTTTCATACAGCTTCCCC  : 251

*        320         *        340         *        360
TrDFRb1 : TGTTCTTGTTCCACATGATGACAACATTCAGGTTACTTTGATTGATCCATGTATAAAAGG  : 360
TrDFRb2 : TGTTCTTGTTCCACATGATGACAACATTCAGGTTACTTTGATTGATCCATGTATAAAAGG  : 335
TrDFRb3 : TGTTCTTGTTCCACATGATGACAACATTCAGGTTACTTTGATTGATCCATGTATAAAAGG  : 316
TrDFRb4 : TGTTCTTGTTCCACATGATGACAACATTCAGGTTACTTTGATTGATCCATGTATAAAAGG  : 311

*        380         *        400         *        420
TrDFRb1 : AACACAAAATGTGCTTAGCTCATGCATCAAAGCAAAGGTGAAACGTGTGGTGTTAACATC  : 420
TrDFRb2 : AACACGAATGTGCTTAACTCATGCATCAAAGCAAAGGTGAAACGTGTGGTGTTAACATC  : 395
TrDFRb3 : AACACAAAATGTGCTTAACTCATGCATCAAAGCAAAGGTGAAACGTGTGGTGTTAACATC  : 376
TrDFRb4 : AACACAAAATGTGCTTAACTCATGCATCATAGCAAAGGTGAAACGTGTGGTGTTAACATC  : 371

*        440         *        460         *        480
TrDFRb1 : TTCATGCTCTTCCATAAGATACCGTGACGATGTGCAACAAATTTCACCACTTAATGAATC  : 480
TrDFRb2 : GTCATGCTCTTCCATAAGATACCGTGACGATGTGCAACAAATTTCTCCTCTTAATGAATC  : 455
TrDFRb3 : TTCATGCTCTTCCATAAGATACCGTGACGATGTGCAACAAATTTCTCCTCTTAATGAATC  : 436
TrDFRb4 : TTCATGCTCTTCCATAAGATACCGTGACGATGTGCAACAAATTTCTCCTCTTAATGAATC  : 431
```

FIGURE 49

```
              *         500         *         520         *         540
TrDFRb1 : TCATTGGAGTGATTCTGAATACTGCAAACGCTATAACCTGTGGTATGCATATGCAAAGAC : 540
TrDFRb2 : TCATTGGAGTCATTCTGATTACTGCAAACGCTATAACCTGTGGTATGCATATGCAAAGAC : 515
TrDFRb3 : TCATTGGAGTGATTCTGAATACTGCAAACGCTATAACCTGTGGTATGCATATGCAAAGAC : 496
TrDFRb4 : TCATTGGAGTCATTCTGAATACTGCAAACGCTATAACCTGTGGTATGCATATGCAAAGAC : 491

*         560         *         580         *         600
TrDFRb1 : ATTAGGAGAAAAAGAAGCATGGAGGATTGC------------------------------ : 570
TrDFRb2 : TTTACGAGAAAAAGAAGCATGGAGGATTGCAAAGGAAAGTGGGATTAATCTAGTTGT--- : 572
TrDFRb3 : TTTAGGAGAAAAAGAAGCATGGAGGATTGCAAAGGAAAGTGGAATTGATCTAGTTGTAGT : 556
TrDFRb4 : TTTAGGAGAAAAAGAAGCATGGAGGATTGCAAACGAAAGTGGAATTGATCTAGTTGTAGT : 551

*         620
TrDFRb1 : ---------------------- :   -
TrDFRb2 : ---------------------- :   -
TrDFRb3 : TAACCCCTCTTTTGTT------ : 572
TrDFRb4 : TAACCCCTCTTTTGTTGGTGGTC : 574
```

FIGURE 49 (cont)

```
                *         20         *         40         *         60
TrDFRc : GNGAAGANCTAGTTTGCGTAACCCGGANCAACGGTTTCATCGGAACATGGCTAGTTAAAA :  60

*         80         *        100         *        120
TrDFRc : CCCTACTCCAAAAACACTACAAAATTCACGCCACAATCTTCCCCAATTCCAACGCATCTC : 120

*        140         *        160         *        180
TrDFRc : ATCTCTTCACACTCCACCCGGAAGCTCAATCCCGGATCACAATTTTCCCTGTCGATATCC : 180

*        200         *        220         *        240
TrDFRc : TCGACTCCACCGCCGTCTTCTCCGCTATCAATAACTGCTCAGGTGTCTTTCATGCCGCTT : 240

*        260         *        280         *        300
TrDFRc : CTCCATGTACCCTCGAAGATCCAACTGATCCGCAAAAAGAGCTTCTAGAACCTGCTGTAC : 300

*        320         *        340         *        360
TrDFRc : AAGGAACCCTAAATGTTCTAGAAGCATCCAGCGCGCAGGTACCAAACCCTAATTGGCCGG : 360

*        380         *        400         *        420
TrDFRc : AGAAAAAGGCGATCGATGAGGCGTCGTGGACGGATGTTGAGTACTGTAAATTGACAGGGA : 420

*        440         *        460         *        480
TrDFRc : AGTGGTATCTGGTGTCGAAAACGGAGGCGGAGAAGGCGGCTTGGGATTTTCGAGAGAAAA : 480

*        500         *        520         *        540
TrDFRc : ATGGTGGTGTTGATGTGGGGGCGGNTCATCCGGGGACTTGTTTGGGAGAGTTGATACAGA : 540

*        560         *        580         *        600
TrDFRc : AGGAGTTGAATGCGAGTTCAGCGGNTTTACAGAGGTTGATGATGGGGAGTGAGGATACTC : 600

*        620         *        640
TrDFRc : AAGAGTGNTATTGGNNGGGGGGCTGNNNATGNTAAAGATGN : 641
```

FIGURE 50

```
              *         20         *         40         *         60
TrDFRc : EXLVCVTRXNGFIGTWLVKTLLQKHYKIHATIFPNSNASHLFTLHPEAQSRITIFPVDIL :  60

*         80         *        100         *        120
TrDFRc : DSTAVFSAINNCSGVFHAASPCTLEDPTDPQKELLEPAVQGTLNVLEASSAQVPNPNWPE : 120

*        140         *        160         *        180
TrDFRc : KKAIDEASWTDVEYCKLRGKWYLVSKTEAEKAAWDFREKNGGVDVGAXHPGTCLGELIQK : 180

*        200
TrDFRc : ELNASSALQRLMMGSEDTQEXYWXGG : 206
```

FIGURE 51

```
              *        20         *        40         *        60
TrDFRd : GCNTTGATCAGCGTATNAACACACANGTCTTCCCTTGAGCTCTGTTTCTCCACATGTCGA :  60

*        80         *       100         *       120
TrDFRd : AGCTAGTTTGCGTCACCGGCGGCAGCGGATGCATCGGTTCATGGCTAGTCCATCTCCTTC : 120

*       140         *       160         *       180
TrDFRd : TCCTCCGCGGCTACACTGTTCACGCCACCGTCCAAAATCTCAATGATGAGAACGAAACGA : 180

*       200         *       220         *       240
TrDFRd : AGCATCTAGAAGCTCTCGAAGGAGCACAAACTAATCTCCGTCTCTTCCAGATCGATCTCC : 240

*       260         *       280         *       300
TrDFRd : TTAACTACGACACAATCCTCGCTGCTGTCCGCGGTTGCGTCGGAATTTTCCACCTCGCTT : 300

*       320         *       340         *       360
TrDFRd : CACCTTGCACTGTAGACAAAGTTCATGATCCTCAGAAGGAGCTTTTGGATCCTGCAATTA : 360

*       380         *       400         *       420
TrDFRd : AAGGGACTTTGAATGTGCTTACTGCAGCTAAGGAAGTAGGGGTGAAGCGTGTGGTTGTTA : 420

*       440         *       460         *       480
TrDFRd : CCTCGTCTGTCTCGGCGATTACTCCTAGTCCTGATTGGCCTTCTGATGTTGTTAAAAGAG : 480

*       500         *       520         *       540
TrDFRd : AGGATTGTTGGACTGATGTTGAATATTGCAAGAAAAAAGAGTTGGGGTATCCGTTGTCCA : 540

*       560         *       580         *       600
TrDFRd : AAACATTGGCTGAAAAAGCTGCGTGGGATTTTTNCAAAGAAAATGGTTTGGATGTTGTTG : 600

*       620         *       640         *       660
TrDFRd : NGGTGAATCCCGGNACTGNGATGGGTCCTGTTTTTCCACCACGGCATAATGCAAGCATGC : 660

*       680         *       700         *       720
TrDFRd : TCATGCCTTGGGAAACTTTTTTTGAAGGCTGGNNCTGAAACATTTGAAGACTATTTTATGG : 720

*       740         *       760         *       780
TrDFRd : GATTGGCCNNCTTTAAAGATGTNGCATTGGCNCATNNTTTGGGGTATGAGAACAAANANN : 780

*       800         *       820
TrDFRd : CTTTGGGANACATNGGNGGGTTGAAACTATCNNTCCTTACGG : 822
```

FIGURE 52

```
              *        20         *        40         *        60
TrDFRd : MSKLVCVTGGSGCIGSWLVHLLLLRGYTVHATVQNLNDENETKHLEALEGAQTNLRLFQI :  60

*        80         *       100         *       120
TrDFRd : DLLNYDTILAAVRGCVGIFHLASPCTVDKVHDPQKELLDPAIKGTLNVLTAAKEVGVKRV : 120

*       140         *       160         *       180
TrDFRd : VVTSSVSAITPSPDWPSDVVKREDCWTDVEYCKKKELGYPLSKTLAEKAAWDFXKENGLD : 180

*       200         *       220         *       240
TrDFRd : VVXVNPXTXMGPVFPPRHNASMLMPWETFLKAXXETFEDYFMGLAXFKDXALXHXLGYEN : 240

*
TrDFRd : KXXLGXXXGLKLXXLT : 256
```

FIGURE 53

```
                    *         20         *         40         *         60
TrDFRd1: GCNTTGATCAGCGTATNAACACACANGTCTTCCCTTGAGCTCTGTTTCTCCNCATGTCGA :  60
TrDFRd2: ------------------------NACANNTCTTCCCTTGAGCTCTGTTTCTCCACATGTCGA :  39

*         80         *        100         *        120
TrDFRd1: AGCTAGTTTGCGTCACCGGCGGCAGCGGATGCATCGGTTCATGGCTAGTCCATCTCCTTC : 120
TrDFRd2: AGCTAGTTTGCGTCACCGGCGGNGGCGGATGCATCGGTTCATGGCTAGTCCATCTCCTTC :  99

*        140         *        160         *        180
TrDFRd1: TCCTCCGCGGCTACACTGTTCACGCCACCGTCCAAAATCTCAATGATGAGAACGAAACGA : 180
TrDFRd2: TCCTCCGCGGCTACACTGTTCACGCCACCGTCCAAAATCTCAATGATGAGAACGAAACGA : 159

*        200         *        220         *        240
TrDFRd1: AGCATCTAGAAGCTCTCGAAGGAGCACAAACTAATCTCCGTCTCTTCCAGATCGATCTCC : 240
TrDFRd2: AGCATCTAGAAGCTCTCGAAGGAGCACAAACTAATCTCCGTCTCTTCCAGATCGATCTCC : 219

*        260         *        280         *        300
TrDFRd1: TTAACTACGACACAATCCTCGCTGCTGTCCGCGGTTGCGTCGGAATTTTCCACCTCGCTT : 300
TrDFRd2: TTAACTACGACACAATCCTCGCTGCTGTCCGCGGTTGCGTCGGAATTTTCCACCTCGCTT : 279

*        320         *        340         *        360
TrDFRd1: CACCTTGCACTGTAGACAAAGTTCATGATCCTCAGAAGGAGCTTTTGGATCCTGCAATTA : 360
TrDFRd2: CACCTTGCACTGTAGACAAAGTTCATGATCCTCAGAAGGAGCTTTTGGATCCTGCAATTA : 339

*        380         *        400         *        420
TrDFRd1: AAGGGACTTTGAATGTGCTTACTGCAGCTAAGGAAGTAGGGGTGAAGCGTGTGGTTGTTA : 420
TrDFRd2: GAGGGACTTTGAATGTGCTTACTGCAGCTAAGGAAGTAGGGGTGAAGCGTGTGGTTGTTA : 399

*        440         *        460         *        480
TrDFRd1: CCTCGTCTGTCTCGGCGATTACTCCTAGTCCTGATTGGCCTTCTGATGTTGTTAAAAGAG : 480
TrDFRd2: CCTCGTCTGTCTCGGCGATTACTCCTAGTCCTGATTGGCCTTCTGATGTTGTTAAAAGAG : 459

*        500         *        520         *        540
TrDFRd1: AGGATTGTTGGACTGATGTTGAATATTGCAAGAAAAAGAGTTGGGGTATCCGTT----- : 535
TrDFRd2: AGGATTGTTGGACTGATGTTGAATATTGCAAGAAAAAGAGTTGGGGTATCCGTTGTCCA : 519

*        560         *        580         *        600
TrDFRd1: ------------------------------------------------------------ :   -
TrDFRd2: AAACATTGGCTGAAAAAGCTGCGTGGGATTTTTNCAAAGAAAATGGTTTGGATGTTGTTC : 579

*        620         *        640         *        660
TrDFRd1: ------------------------------------------------------------ :   -
TrDFRd2: NGGTGAATCCCGGNACTGNGATGGGTCCTGTTTTTCCACCACGGCATAATGCAAGCATGC : 639
```

FIGURE 54

```
                  *         680         *         700         *         720
TrDFRd1 : ------------------------------------------------------------------ : -
TrDFRd2 : TCATGCCTTGGGAAACTTTTTTGAAGGCTGGNNCTGAAACATTTGAAGACTATTTTATGG       : 699

*         740         *         760         *         780
TrDFRd1 : ------------------------------------------------------------------ : -
TrDFRd2 : GATTGGCCNNCTTTAAAGATGTNGCATTGGCNCATNNTTTGGGGTATGAGAACAAANANN      : 759

*         800         *         820
TrDFRd1 : ---------------------------------------------- : -
TrDFRd2 : CTTTGGGANACATNGGNGGGTTGAAACTATCNNTCCTTACGG      : 801
```

FIGURE 54 (cont)

```
             *         20         *         40         *         60
TrDFRe : GTCACTTATGAAATGGAACACAAAGGTGGAGACAAAGTATGTGTGACAGGGGCATCAGGC :  60

*         80         *        100         *        120
TrDFRe : TTTTTAGCATCTTGGCTTATTAAGAAACTTCTTTTGTCTGGCTATCAAGTCATTGGAACA : 120

*        140         *        160         *        180
TrDFRe : GTTAGAGATTTAGGGAAGAAGAAGAAAGTTGAACATTTATGGAAATTGGAAGGAGCAACA : 180

*        200         *        220         *        240
TrDFRe : GAAAGACTAGAACTAATCCAAGCTGATTTAATGGAAGAAAATAGTTTCGACAAAGCGATC : 240

*        260         *        280         *        300
TrDFRe : ATGGGATGCAAAGGTGTCTTCCACATTGCCTCTCCAGTACTCAATCATATATCAGATAAT : 300

*        320         *        340         *        360
TrDFRe : CCTAAGGCGGAAATCTTGGAACCGGCAGTCCAAGGTACGCTAAATGTGTTGCGTTCTTGT : 360

*        380         *        400         *        420
TrDFRe : AAGAGGAACCCCGATCTTGTTCGAGTGGTGCTAGCCTCATCATCTTCGGCTGTTAGAGTA : 420

*        440         *        460         *        480
TrDFRe : AGAGCTGATTTTGATCCAAGCATACCAATTGATGAATCATCTTGGAGCTCCTTGGAATTG : 480

*        500         *        520         *        540
TrDFRe : TGCGAGAAACTCAAGGCATGGTACCCAATGTCAAAGACAATGGCAGAAAAAGCAGCTTGG : 540

*        560         *        580
TrDFRe : GAATATAGCAAAGAGAATGGAATAGACTTAGTGACTATTTTC : 582
```

FIGURE 55

```
                  *        20         *        40         *        60
TrDFRe : MEHKGGDKVCVTGASGFLASWLIKKLLLSGYQVIGTVRDLGKKKKVEHLWKLEGATERLE :  60

*        80         *       100         *       120
TrDFRe : LIQADLMEENSFDKAIMGCKGVFHIASPVLNHISDNPKAEILEPAVQGTLNVLRSCKRNP : 120

*       140         *       160         *       180
TrDFRe : DLVRVVLASSSSAVRVRADFDPSIPIDESSWSSLELCEKLKAWYPMSKTMAEKAAWEYSK : 180

*
TrDFRe : ENGIDLVTIF : 190
```

FIGURE 56

```
               *        20         *        40         *        60
TrDFRf : TNCNNGCTNCNTNCGGGCAGAGANTTTCCCTGACCTATNTGTTACTNAAGAATATTTCTA : 60

*        80         *       100         *       120
TrDFRf : TATATATATTTGTGTTTCAAGAACCCAAAAAATAGAATAGTGATGGAAAGGAGTTGCAAG : 120

*       140         *       160         *       180
TrDFRf : GTTTGTGTCACCGGTGGTGCTGGTTATATTGGTTCTCTTTTAGTCAAAAAGCTTTTGGAA : 180

*       200         *       220         *       240
TrDFRf : AAGGGTTACACCGTTCATGCTACTCTTAGAAACTTGAAGGACGAATCCAAAGTAGATTTT : 240

*       260         *       280         *       300
TrDFRf : TTGAGAGGCTTTCCACATGCAGATACTAGACTTATGTTATTTGAAGCTGATATATACAAA : 300

*       320         *       340         *       360
TrDFRf : TCAGATGAATTTTGGCCCGCAATTCAAGGTTGTGAGTTTGTTTTTCACCTTGCTACTCCT : 360

*       380         *       400         *       420
TrDFRf : TTTCAACATCAAACTGATTCTCAGTTTAAGAGCATAGAGGAAGCTGCAATAGCAGGGGTA : 420

*       440         *       460         *       480
TrDFRf : AAAAGCATAGCTGAAAATTGCATAAAATCAGGAACAGTGAGAAAATTGATATACACTGGA : 480

*       500         *       520         *       540
TrDFRf : ACTGTAATTGCTTCTTCTTCTCTGAAAGATGATGGAAGTGGCTACAAAGACTTCATTGAT : 540

*       560         *
TrDFRf : GAAACTTGTTGGACACCTCTCCATCTTCCTCT : 572
```

FIGURE 57

```
                *         20         *         40         *         60
TrDFRf :  MERSCKVCVTGGAGYIGSLLVKKLLEKGYTVHATLRNLKDESKVDFLRGFPHADTRLMLF :  60

*         80         *        100         *        120
TrDFRf :  EADIYKSDEFWPAIQGCEFVFHLATPFQHQTDSQFKSIEEAAIAGVKSIAENCIKSGTVR : 120

*        140         *
TrDFRf :  KLIYTGTVIASSSLKDDGSGYKDFIDETCWTPLHLP : 156
```

FIGURE 58

```
            *        20         *        40         *        60
TrDFRg : GCCNTTGCCTACTACTAAACTATATATTATTATTATATTATATGATGATACATAGTGACA : 60

*        80         *       100         *       120
TrDFRg : TTAATAATTGGAAGGGAGAATAAATAGTTGAAAAACACACAGTTGGAGTGTTTTTGTTGT : 120

*       140         *       160         *       180
TrDFRg : TAAAGAAGCTNGAAAATGGAGGAAGCNACAAAGATGGTGAAAAAGAGTGGACAAATTGTT : 180

*       200         *       220         *       240
TrDFRg : CCTACTGCCAAATACTGTGTTACAGGAGCAACAGGCTATATTGGTTCATGGCTTGTTGAA : 240

*       260         *       280         *       300
TrDFRg : GCTCTTCTTCAAAGAGGTTGCACTGTTCATGCTACTGTTAGAGATCCTGAAAAATCGTTA : 300

*       320         *       340         *       360
TrDFRg : CACCTCCTGTCGTTGTGGAAAGGTAGTGACCAATTGAGAATTTTCCGTGCGGATTTGCAA : 360

*       380         *       400         *       420
TrDFRg : GAAGAAGGAAGTTTCGATGATGCCGTAAAAGGATGTATTGGTGTGTTCCATGTTGCAGCT : 420

*       440         *       460         *       480
TrDFRg : TCAATGCAATTCAATATTAGTGACAAAGAAAACACTGAGGACTTTGTTGAAGCAAATATA : 480

*       500         *       520         *       540
TrDFRg : ATTGACCCTGCAATCAAAGGAACCATAAATCTTCTCAAATCATGCTTGAAATCAAATTCA : 540

*       560         *       580         *       600
TrDFRg : GTGAAAAGGGTTGTTTTCACATCTTCCATAAGTACTATTACTGCTAAAGACAACGACGGA : 600

*       620         *       640         *       660
TrDFRg : AAATGGAAACCTATTGTTGATGAATCTTGCCAAACAAAAACTGAGATTCTGTGGAATACA : 660

*       680         *       700         *
TrDFRg : CAACCAAGTGGATGGGTTTATGCACTTTCAAAGCTTCATGCAGAAGAAGCGGCT : 714
```

FIGURE 59

```
                *         20         *         40         *         60
TrDFRg : MVKKSGQIVPTAKYCVTGATGYIGSWLVEALLQRGCTVHATVRDPEKSLHLLSLWKGSDQ :  60

*         80         *        100         *        120
TrDFRg : LRIFRADLQEEGSFDDAVKGCIGVFHVAASMQFNISDKENTEDFVEANIIDPAIKGTINL : 120

*        140         *        160         *        180
TrDFRg : LKSCLKSNSVKRVVFTSSISTITAKDNDGKWKPIVDESCQTKTEILWNTQPSGWVYALSK : 180

TrDFRg : LHAEEAA : 187
```

FIGURE 60

```
                *         20         *         40         *         60
TrDFRg1:  GCCNTTGCCTACTACTAAACTATATATTATTATTATATTATATGATGATACATAGTGACA  :  60
TrDFRg2:  ------------------------------------------------------------  :   -
TrDFRg3:  ------------------------------------------------------------  :   -

*         80         *        100         *        120
TrDFRg1:  TTAATAATTGGAAGGGAGAATAAATAGTTGAAAAACACACAGTTGGAGTGTTTTTGTTGT  :  120
TrDFRg2:  ------------------------------------------------------------  :   -
TrDFRg3:  ------------------------------------------------------------  :   -

*        140         *        160         *        180
TrDFRg1:  TAAAGAAGCTATAAAATGGAGGAAACAACAAAGATGGTGAAAAATAGTGGACAAATTGTT  :  180
TrDFRg2:  ---AGAAGCTNGAAAATGCAGGAAGNNACAAAGATGGTGAAAAAGAGTGGACAAATTGTT  :   57
TrDFRg3:  --------CTNGAAAATGGAGGAAGCNACAAAGATGGTGAAAAAGAGTGGACAAATTGTT  :   52

*        200         *        220         *        240
TrDFRg1:  CCTACTGCCAAATACTGTCTTACAGGAGCTACAGGCTATATTGGTTCATGGCTTGTTGAA  :  240
TrDFRg2:  CCTACTGCCAAATACTGTGTTACAGGAGCAACAGGCTATATTGGTTCATGGCTTGTTGAA  :  117
TrDFRg3:  CCTACTGCCAAATACTGTGTTACAGGAGCAACAGGCTATATTGGTTCATGGCTTGTTGAA  :  112

*        260         *        280         *        300
TrDFRg1:  GCTCTTCTTCAAAGAGGTTGCACTGTTCATGCTACTGTTAGAGATCCTG-----------  :  289
TrDFRg2:  GCTCTTCTTCAAAGAGGTTGCACTGTTCATGCTACTGTTAGAGATCCTGAAAAATCGTTA  :  177
TrDFRg3:  GCTCTTCTTCAAAGAGGTTGCACTGTTCATGCTACTGTTAGAGATCCTGAAAAATCGTTA  :  172

*        320         *        340         *        360
TrDFRg1:  ------------------------------------------------------------  :   -
TrDFRg2:  CACCTCCTGTCGTTGTGGAAAGGTAGTGACCAATTGAGAATTTTCCGTGCGGATTTGCAA  :  237
TrDFRg3:  CACCTCCTGTCGTTGTGGAAAGGTAGTGACCAATTGAGAATTTTCCGTGCGGATTTGCAA  :  232

*        380         *        400         *        420
TrDFRg1:  ------------------------------------------------------------  :   -
TrDFRg2:  GAAGAAGGAAGTTTCGATGATGCCGTAAAAGGATGTATTGGTGTGTTCCATGTTGCAGCT  :  297
TrDFRg3:  GAAGAAGGAAGTTTCGATGATGCCGTAAAAGGATGTATTGGTGTGTTCCATGTTGCAGCT  :  292

*        440         *        460         *        480
TrDFRg1:  ------------------------------------------------------------  :   -
TrDFRg2:  TCAATGCAATTCAATATTAGTGACAAAGAAAACACTGAGGACTTTGTTGAAGCAAATATA  :  357
TrDFRg3:  TCAATGCAATTCAATATTAGTGACAAAGAAAACACTGAGGACTTTGTTGAAGCAAATATA  :  352

*        500         *        520         *        540
TrDFRg1:  ------------------------------------------------------------  :   -
TrDFRg2:  ATTGACCCTGCAATCAAAGGAACCATAAATCTTCTCAAATCATGCTTGAAATCAAATTCA  :  417
TrDFRg3:  ATTGACCCTGCAATCAAAGGAACCATAAATCTTCTCAAATCATGCTTGAAATCAAATTCA  :  412
```

FIGURE 61

```
              *         560         *         580         *         600
TrDFRg1 : ------------------------------------------------------------ : -
TrDFRg2 : GTGAAAAGGGTTGTTTTCACATCTTCCATAAGTACTATTACTGCTAAAGACAACGACGGA : 477
TrDFRg3 : GTGAAAAGGGTTGTTTTCACATCTTCCATAAGTACTATTACTGCTAAAGACAACGACGGA : 472

*         620         *         640         *         660
TrDFRg1 : ------------------------------------------------------------ : -
TrDFRg2 : AAATGGAAACCTATTGTTGATGAATCTTGCCAAACAAAAACTGAGATTCTGTGGAATACA : 537
TrDFRg3 : AAATGGAAACCTATTGTTGATGAATCTTGCCAAACAAAAACTGAGATTCTGTGGAATACA : 532

*         680         *         700         *
TrDFRg1 : -------------------------------------------------- : -
TrDFRg2 : CAACCAAGTGGATGGGTTTATGCACTTTCAAAGCTTCATGCAGAAGAAGCGGCT : 591
TrDFRg3 : CAACCAAGTGGATGGGTTTATGCACTTTCAAAGCTTCATG------------- : 572
```

FIGURE 61 (cont)

```
          *        20         *        40         *        60
TrDFRh : GNNGNGTCTTCCGTTNAATTTNAGNCTATATTGAAAAGGAAAAAAAGAGTAGAGAAGTGA : 60

*        80         *       100         *       120
TrDFRh : AGTGAAGTGAAAACATACATGGGTTCCGAATCAGAAATAGTTTGTGTTACCGGAGCTTCA : 120

*       140         *       160         *       180
TrDFRh : GGTTTCATCGGATCGTGGCTTGTTATGAGACTTATAGAGCGTGGCTACACGGTTCGAGCC : 180

*       200         *       220         *       240
TrDFRh : ACCGTTCGCGACCCAGATAACATGAAGAAGGTGAAGCATTTGGTGGAACTGCCGGGTGCA : 240

*       260         *       280         *       300
TrDFRh : AAAAGCAAATTGTCTCTTTGGAAGGCTGATCTTGATAAAGAGGGGAGTTTTGATGAAGCA : 300

*       320         *       340         *       360
TrDFRh : ATTAAAGGGTGCACAGGAGTTTTTCATGTTGCTACACCAATGGATTTTGAATCCAAGGAC : 360

*       380         *       400         *       420
TrDFRh : CCTGAGAATGAAGTGATAAAGCCTACAATAAATGGATTAATAGACATACTGAAAGCATGC : 420

*       440         *       460         *       480
TrDFRh : GAAAAGGCAAAAACAGTTAGAAAATTGGTTTTCACATCATCGGCTGGAACTGTGGACGTT : 480

*       500         *       520         *       540
TrDFRh : ACTGAACATCCAAAGTCTATTATTGATGAAACATGCTGGAGTGACGTTGACTTTTGCCGT : 540

*       560         *       580         *       600
TrDFRh : AGAGTCAAGATGACCGGTTGGATGTATTTTGTTTCAAAGACCCTAGCAGAGCAAGAAGCT : 600

*       620         *       640         *       660
TrDFRh : TGGAAGTATTCGAAAGAGCACAACATAGACTTTGTCTCCATCATTCCACCTCTTGTTGTT : 660

*       680         *       700         *       720
TrDFRh : GGCCCCTTTCTTATGGCCTCAATGCCACCTAGTCTAATCACTGCTCTTTCTCTTATCACA : 720

*       740         *       760         *       780
TrDFRh : GGAAATGAGGCCCATTACTCAATCATAAAGCAAGGGCAATACGTCCATTTAGATGACCTT : 780

*       800         *       820         *       840
TrDFRh : TGTCTTGCTCATATATTTCTGTATGAGAATCCAAAAGCTCAAGGGAGATACATTTGCTGT : 840
```

FIGURE 62

```
              *         860         *         880         *         900
TrDFRh : TCACATGAAGCAACCATTCATCAAGTTGCAAAACTTATTAAAGAAAAATACCCAGAGTTC : 900

*         920         *         940         *         960
TrDFRh : AATGTCCCAACAAAATTCAATGATATCCCAGATGAATTGGAAATTATTAAATTTTCTAAA : 960

*
TrDFRh : AAGAAGATCACAGACT : 976
```

FIGURE 62 (cont)

```
              *        20         *        40         *        60
TrDFRh : MGSESEIVCVTGASGFIGSWLVMRLIERGYTVRATVRDPDNMKKVKHLVELPGAKSKLSL :  60

*        80         *       100         *       120
TrDFRh : WKADLDKEGSFDEAIKGCTGVFHVATPMDFESKDPENEVIKPTINGLIDILKACEKAKTV : 120

*       140         *       160         *       180
TrDFRh : RKLVFTSSAGTVDVTEHPKSIIDETCWSDVDFCRRVKMTGWMYFVSKTLAEQEAWKYSKE : 180

*       200         *       220         *       240
TrDFRh : HNIDFVSIIPPLVVGPFLMASMPPSLITALSLITGNEAHYSIIKQGQYVHLDDLCLAHIF : 240

*       260         *       280         *
TrDFRh : LYENPKAQGRYICCSHEATIHQVAKLIKEKYPEFNVPTKFNDIPDELEIIKFSKKKITD  : 299
```

FIGURE 63

|  | * | 20 | * | 40 | * | 60 |  |
|---|---|---|---|---|---|---|---|
| TrDFRh1  : | GNNNTGTCTTCCGTTNAATTTNAGNCTATATTGAAAAAGAAAAAAAGAGTAGNNNANNGA | : 60 |
| TrDFRh2  : | -NNNTGTCTTAAATCCAATTTCAGNCTAAATTGAAAAGGAAAAAAAGAGGAGAGAAGTCA | : 59 |
| TrDFRh3  : | ---GNGTCTTCCGTTNAATTTNAGNCTATATTGAAAAAGAAAAAAAGAGTAGNNNANNGA | : 57 |
| TrDFRh4  : | ---GNGTCTTCCGTTNAATTTNAGNCTATATTGAAAAAGAAAAAAAGAGTAGAGAANNGN | : 57 |
| TrDFRh5  : | ---GNGTCTTCCGTTNAATTTAAGNCTATATTGAAAAGNAAAAAAAGAGTAGNNNANNGA | : 57 |
| TrDFRh6  : | ---GNGTCTTCCGTTNAANTTAAGNCTATATTGAAAAGNAAAAAAAGAGTAGNNNANNGA | : 57 |
| TrDFRh7  : | ---GNGTCTTCCGTTNAATTTNAGNCTATATTGAAAAAGAAAAAAAGAGTAGAGAAGTGA | : 57 |
| TrDFRh8  : | ----GGTCTTCCNTTNAATTNNAGNCNANATTGAAAAGGAAAAAAAGAGGAGAGAAGTGA | : 56 |
| TrDFRh9  : | ----GGTCTTCCGTTNAATTTAAGNCTATATTGAAAANGAAAAAAAGAGTAGAGAAGTGA | : 56 |
| TrDFRh10: | ----GGTCTTCCGTTNNATTTAAGNCTATATTGAAAAAGAAAAAAAGAGTAGAGAAGTGA | : 56 |
| TrDFRh11: | -----GTCTTCNNTTNAATTQNAGNCNAAATTGAAAAGGAAAAAAAGAGGAGAGAAGTGA | : 55 |
| TrDFRh12: | -----GTCTTCCGTTCNATTTNAGNCTATATTGAAAAGNAAAAAAAGAGTAGACAANNGN | : 55 |
| TrDFRh13: | --------GGTCTTCTTNAATCGAGCTAAATTGAAAAGGAAAAAAAGAGGAGAGAAGTGA | : 52 |
| TrDFRh14: | --------------------------------------------GNAGAGAAGTNA | : 12 |
| TrDFRh15: | ------------------------------------------------------------ | : - |

|  | * | 80 | * | 100 | * | 120 |  |
|---|---|---|---|---|---|---|---|
| TrDFRh1  : | AGTGAAGTGAAAACATACATGGGTTCCGAATCAGAAATAGTTTGTGTTACCGGAGCTTCA | :120 |
| TrDFRh2  : | ANTGNAGTGAAAANATACATGGGTTCNGAATCNGAAAATAGTTTCNGTTACCGGAGCTTCA | :119 |
| TrDFRh3  : | AGTGAAGTGAANACATACATGGGTTCCGAATCAGAAATACTTTCNGTTACCGGAGCTTCA | :117 |
| TrDFRh4  : | NNTGAAGTGAAAACATACATGGGTTCCGAATCAGAAAATAGTTTGTGTTACCGGAGCTTCA | :117 |
| TrDFRh5  : | AGTGAAGTGAAAACATACATGGGTTCCGAATCAGAAATAGTTTGTGTTACCGGAGCTTCA | :117 |
| TrDFRh6  : | AGTGAAGTGAAAACATACATGGGTTCCGAATCAGAAATAGTTTGTGTTACCGGAGCTTCA | :117 |
| TrDFRh7  : | AGTGAAGTGAAAACATACATGGGTTCNGAATCAGAAATAGTTTGTGTTACCGGAGCNTCA | :117 |
| TrDFRh8  : | ANTGAAGTGAAANATACATGGGTTCCGAATCNGAAATAGTTTGTGTTACCGGAGCTTCA | :116 |
| TrDFRh9  : | AGTGAAGTGAAAACATACATGGGTTCNGAATCAGAAATAGTTTGTGTTACCGGAGCNTCA | :116 |
| TrDFRh10: | AGTGAAGTGAAAACATACATGGGTTCNGAATCAGAAATAGTTTGTGTTACCGGAGCNTCA | :116 |
| TrDFRh11: | ANTGAAGTGAAAANATACATGGGTTCCGAATCNGAAATAGTTTGTGTTACCGGAGCTTCA | :115 |
| TrDFRh12: | NNTGAAGTGAAAACATACATGGGTTCCGAATCAGAAATAGTTTGTGTTACCGGAGCTTCA | :115 |
| TrDFRh13: | ANTGNAGTGAAAANATACATGGGTTCNGAATCNGAAATAGTTTGTGTTACCGGAGCTTCA | :112 |
| TrDFRh14: | CNTGNAGTGAAAANATACATGGGTTCNCAATCNGAAATAGTTTGTGTTACCGGAGCTTCA | : 72 |
| TrDFRh15: | ------------------------------------------------------------ | : - |

|  | * | 140 | * | 160 | * | 180 |  |
|---|---|---|---|---|---|---|---|
| TrDFRh1  : | NGTTTCATCGGATCGTGGCTTGTTATGAGACTTATAGAGCGTGGCTACACGGTTCGAGCC | :180 |
| TrDFRh2  : | GGTTTCATCGGNTCGTGGCTTGTTATGAGACTTATGGAGCNTGGCTACACNGTTCGAGCC | :179 |
| TrDFRh3  : | NGTTTNATCGGATCGTGGCTTGTTATGAGACTTATANAGCGTGNCTACACGGNTCGAGCC | :177 |
| TrDFRh4  : | NGTTTCATCGGATCGTGGCTTGTTATGAGACTTATAGAGCGTGGCTACACGGTTCGAGCC | :177 |
| TrDFRh5  : | GGTTTCATCGGATCGTGGCTTGTTATGAGACTTATAGAGCGTGGCTACACGGTTCGAGCC | :177 |
| TrDFRh6  : | GGTTTCATCGGATCGTGGCTTGTTATGAGACTTATAGAGCGTGGCTACACGGTTCGAGCC | :177 |
| TrDFRh7  : | GGTTTCATCGGATCGTGGCTTGTTATGAGACTTATAGAGCGTGGCTACACGGTTCGAGCC | :177 |
| TrDFRh8  : | GGTTTCATCGGNTCGTGGCTTGTTATGAGACTTATCGAGCGCGGCTACACGGTTCGAGCC | :176 |
| TrDFRh9  : | GGTTTCATCGGATCGTGGCTTGTTATGAGACTTATAGAGCGTGGCTACACGGTTCGAGCC | :176 |
| TrDFRh10: | GGTTTCATCGGATCGTGGCTTGTTATGAGACTTATAGAGCGTCGCTACACGGTTCGAGCC | :176 |
| TrDFRh11: | GGTTTCATCGGNTCGTGGCTTGTTATGAGACTTATGGAGCGCGGCTACACGGTTCGAGCC | :175 |
| TrDFRh12: | GGTTTCATCGGATCGTGGCTTGTTATGAGACTTATAGAGCGTGGCTACACGGTTCGAGCC | :175 |
| TrDFRh13: | GGTTTCATCGGNTCGTGGCTTGTTATGAGACTTATGGAGCGTGGCTACACTGTTCGAGCC | :172 |
| TrDFRh14: | GGTTTCATCGGNTCGTGGCTTGTTATGAGACTTATGGAGCGTGGCTACACTGTTCGAGCC | :132 |
| TrDFRh15: | ------------------------------------------------------------ | : - |

FIGURE 64

```
              *         200         *         220         *         240
TrDFRh1  : ACCGTTCGCGACCCAGATAACATGAAGAAGGTGAAGCATTTGGTGGAACTGCCGGGTGCA :240
TrDFRh2  : ACCGTTCGTGACCCAGATAACATGAAGAANCTGAACCATTTGCTGGAACTGCCAGGTGCA :239
TrDFRh3  : ACCGTTCGCGACCCAGATAACATGAAGAAGGTGAAGCATTTGGTGGAACTGCCGGGTGCA :237
TrDFRh4  : ACCGTTCGCGACCCAGATAACATGAAGAAGGTGAAGCATTTGGTGGAACTGCCGGGTGCA :237
TrDFRh5  : ACCGTTCGCGACCCAGATAACATGAAGAAGGTGAAGCATTTGGTGGAACTGCCGGGTGCA :237
TrDFRh6  : ACCGTTCGCGACCCAGATAACATGAAGAAGGTGAAGCATTTGGTGGAACTGCCGGGTGCA :237
TrDFRh7  : ACTGTTCGCGACCCAGATAACATGAAGAAGGTGAAGCATTTGGTGGAACTGCCGGGTGCA :237
TrDFRh8  : ACTGTTCGCGACCCAGATAACATGAAGAAGGTGAAGCATTTGATGGAACTGCCGGGTGCA :236
TrDFRh9  : ACTGTTCGCGACCCAGATAACATGAAGAAGGTGAAGCATTTGGTGGAACTGCCGGGTGCA :236
TrDFRh10 : ACTGTTCGCGACCCAGATAACATGAAGAAGGTGAAGCATTTGGTGGAACTGCCGGGTGCA :236
TrDFRh11 : ACTGTTCGCGACCCAGATAACATGAAGAAGGTGAAGCATTTCATGGAACTGCCGGGTGCA :235
TrDFRh12 : ACCGTTCGCGACCCAGATAACATGAAGAAGGTGAAGCATTTGGTGGAACTGCCGGGTGCA :235
TrDFRh13 : ACCGTTCCTGACCCAGATAACATGAAGAAGGTGAAGCATTTGCTGGAACTGCCGGGTGCA :232
TrDFRh14 : ACCGTTCGTGACCCAGATAACATGAAGAAGGTGAAGCATTTCGTGCAACTGCCGGGTGCA :192
TrDFRh15 : ------------------------------------------------------------ : -

*         260         *         280         *         300
TrDFRh1  : AAAAGCAAATTGTCTCTTTGGAAGGCTGATCTTGATAAAGAGGGGAGTTTTGATGAAGCA :300
TrDFRh2  : AAAAGCAAATTGTCTCTTTGGAAGGCTGATCTTGATAAAGAGGGGAGTTTTGATGAAGCA :299
TrDFRh3  : AAAAGCAAATTGTCTCTTTGGAAGGCTGATCTTGATAAAGAGGGGAGTTTTGATGAAGCA :297
TrDFRh4  : AAAAGCAAATTGTCTCTTTGGAAGGCTGATCTTGATAAAGAGGGGAGTTTTGATGAAGCA :297
TrDFRh5  : AAAAGCAAATTGTCTCTTTGGAAGGCTGATCTTGATAAAGAGGGGAGTTTTGATGAAGCA :297
TrDFRh6  : AAAAGCAAATTGTCTCTTTGGAAGGCTGATCTTGATAAAGAGGGGAGTTTTGATGAAGCA :297
TrDFRh7  : AAAAGCAAATTGTCTCTTTGGAAGGCTGATCTTGATAAAGAGGGGAGTTTTGATGAAGCA :297
TrDFRh8  : AAAAGCAAATTGTCTCTTTGGAAGGCTGATCTTGATAAAGAGGGGAGTTTTGATGAAGCA :296
TrDFRh9  : AAAAGCAAATTGTCTCTTTGGAAGGCTGATCTTGATAAAGAGGGGAGTTTTGATGAAGCA :296
TrDFRh10 : AAAAGCAAATTGTCTCTTTGGAAGGCTGATCTTGATAAAGAGGGGAGTTTTGATGAAGCA :296
TrDFRh11 : AAAAGCAAATTGTCTCTTTGGAACCCTCATCTTGATAAAGAGGGGAGTTTTGATGAAGCA :295
TrDFRh12 : AAAAGCAAATTGTCTCTTTGGAAGGCTGATCTTGATAAAGAGGGGAGTTTTGATGAAGCA :295
TrDFRh13 : AAAAGCAAATTGTCTCTTTGGAAGGCTGATCTTGATAAAGAGGGGAGTTTTGATGAAGCA :292
TrDFRh14 : AAAAGCAAATTGTCTCTTTGGAAGGCTGATCTTGATAAAGAGGGGAGTTTTGATGAAGCA :252
TrDFRh15 : ------------------------------------------------------------ : -

*         320         *         340         *         360
TrDFRh1  : ATTAAAGGGTGCACAGGAGTTTTTCATGTTGCTACACCAATGGATTTTGAATCCAAGGAC :360
TrDFRh2  : ATTAAAGGGTGCACAGGAGTTTTTCATGTTGCTACACCAATGGATTTTGAGTCCAAGGAC :359
TrDFRh3  : ATTAAAGGGTGCACAGGAGTTTTTNATGTTGCTACACCAATGGATTTTGAATCCAAGGAC :357
TrDFRh4  : ATTAAAGGGTGCACAGGAGTTTTTCATGTTGCTACACCAATGGATTTTGAATCCAAGGAC :357
TrDFRh5  : ATTAAAGGGTGCACAGGAGTTTTTCATGTTGCTACACCAATGGATTTTGAATCCAAGGAC :357
TrDFRh6  : ATTAAAGGGTGCACAGGAGTTTTTCATGTTGCTACACCAATGGATTTTGAATCCAAGGAC :357
TrDFRh7  : ATTAAAGGGTGCACAGGAGTTTTTCATGTTGCTACACCAATGGATTTTGAATCCAAGGAC :357
TrDFRh8  : ATTAAAGGGTGCACAGGAGTTTTTCATGTTGCTACACCAATGGATTTTGAATCCAAGGAC :356
TrDFRh9  : ATTAAAGGGTGCACAGGAGTTTTTCATGTTGCTACACCAATGGATTTTGAATCCAAGGAC :356
TrDFRh10 : ATTAAAGGGTGCACAGGAGTTTTTCATGTTGCTACACCAATGGATTTTGAATCCAAGGAC :356
TrDFRh11 : ATTAAAGGGTGCACAGGAGTTTTTCATGTTGCTACACCAATGGATTTTGAATCCAAGGAC :355
TrDFRh12 : ATTAAAGGGTGCACAGGAGTTTTTCATGTTGCTACACCAATGGATTTTGAATCCAAGGAC :355
TrDFRh13 : ATTAAAGGGTGCACAGGAGTTTTTCATGTTGCTACACCAATGGATTTTGAATCCAAGGAC :352
TrDFRh14 : ATTAAAGGGTGCACAGGAGTTTTTCATGTTGCTACACCAATGGATTTTGAGTCCAAGGAC :312
TrDFRh15 : ------------------------------------------------------------ : -
```

FIGURE 64 (cont)

```
              *         380         *         400         *         420
TrDFRh1  : CCTGAGAATGAAGTGATAAAGCCTACAATAAATGGATTAATAGACATACTGAAAGCATGC :420
TrDFRh2  : CCTGAGAATGAAGTGATAAAGCCTACAATAAACGGATTAATAGACATACTGAAAGCATGC :419
TrDFRh3  : CCTGAGAATGAAGTGATAAAGCCTACAATAAATGGATTAATAGACATACTGAAAGCATGC :417
TrDFRh4  : CCTGAGAATGAAGTGATAAAGCCTACAATAAATGGATTAATAGACATACTGAAAGCATGC :417
TrDFRh5  : CCTGAGAATGAAGTGATAAAGCCTACAATAAATGGATTAATAGACATACTGAAAGCATGC :417
TrDFRh6  : CCTGAGAATGAACTGATAAAGCCTACAATAAATGGATTAATAGACATACTGAAAGCATGC :417
TrDFRh7  : CCTGAGAATGAAGTGATAAAGCCTACAATAAATGGATTAATAGACATACTGAAAGCATGC :417
TrDFRh8  : CCTGAGAACGAAGTGATAAAGCCTACAATAAATGGAGTAATAGACATACTGAGAGCATGT :416
TrDFRh9  : CCTGAGAATGAAGTGATAAAGCCTACAATAAATGGATTAATAGACATACTGAAAGCATGC :416
TrDFRh10 : CCTGAGAATGAAGTGATAAAGCCTACAATAAATGGATTAATAGACATACTGAAAGCATGC :416
TrDFRh11 : CCTGAGAACGAAGTGATAAAGCCTACAATAAATGGACTAATAGACATACTGAGAGCATGT :415
TrDFRh12 : CCTGAGAATGAAGTGATAAAGCCTACAATAAATGGATTAATAGACATACTGAAAGCATGC :415
TrDFRh13 : CCTGAGAATGAAGTGATAAAGCCTACAATAAACGGATTAATAGACATACTGAAAGCATGC :412
TrDFRh14 : CCTGAGAATGAAGTGATAAAGCCTACAATAAACGGATTAATAGACATACTGAAAGCATGC :372
TrDFRh15 : --------------------------------------------TACTGAAAGNNTGC : 14

*         440         *         460         *         480
TrDFRh1  : GAAAAGGCAAAAACAGTTANAAAATTGGTTTTCACATCATCGGCTGGAACTGTGGACGTT :480
TrDFRh2  : GAAAAGGCAAAAACAGTTAGAAAATTGGTTTTCACATCATCGGCTGGAACTGTGGACGTT :479
TrDFRh3  : NAAAAGGCAAAAACAGTTAAAAAATTGGTTTTCACATCATCGGCTGAACTGTGGACGTT :477
TrDFRh4  : GAAAAGGCAAAAACAGTTAAAAAATTGGTTTTCACATCATCGGCTGGAACTGTGGACGTT :477
TrDFRh5  : GAAAAGGCAAAAACAGTTAGAAAATTGGTTTTCACATCATCGGCTGGAACTGTGGACGTT :477
TrDFRh6  : GAAAAGGCAAAAACAGTTAGAAAATTGGTTTTCACATCATCGGCTGGAACTGTGGACGTT :477
TrDFRh7  : GAAAAGGCAAAAACAGTTANAAAATTGGTTTTCACATCATCGGCTGGAACTGTGGACGTT :477
TrDFRh8  : GAAAAGGCAAAAACANTTAGAAGATTGGTTTTCACATCATCAGCTGGAACTGTGGACGTA :476
TrDFRh9  : GAAAAGGCAAAAACAGTTAAAAAATTGGTTTTCACATCATCGGCTGGAACTGTGGACGTT :476
TrDFRh10 : GAAAAGGCAAAAACAGTTANAAAATTGGTTTTCACATCATCGGCTGGAACTGTGGACGTT :476
TrDFRh11 : GAAAAGGCAAAAACANTTAGAAGATTGGTTTTCACATCATCNGCTGGAACTGTGGACGTA :475
TrDFRh12 : GAAAAGGCAAAAACAGTTAGAAAATTGGTTTTCACATCATCGGCTGGAACTGTGGACGTT :475
TrDFRh13 : GAAAAGGCAAAAACAGTTAGAAAATTGGTTTTCACATCATCGGCTGGAACTGTGGACGTT :472
TrDFRh14 : GAAAAGGCAAAAACAGTTAGAAAATTGGTTTTCACATCATCGGCTGGAACTGTGGACGTT :432
TrDFRh15 : GAAAAGGCNAAAAACAGTTAGAAAATTGGTTTTCACATCATCGGCTGGAACTGTGGACGTT : 74

*         500         *         520         *         540
TrDFRh1  : ACTGAACATCCAAAGTCTATTATTGATGAAACATGCTGGAGTGACGTTGACTTTTGCCGT :540
TrDFRh2  : ACTGAACATCCAAAGTCTATTATTGATGAAACATGCTGGAGTGACGTTGACTTTTGCCGT :539
TrDFRh3  : ACTGAACATCCAAAGN-------------------------------------------- :493
TrDFRh4  : ACTGAACATCCAAAGTCTATTATTGATGAAACATGCTGGAGTGACGTTGACTTTTGCCGT :537
TrDFRh5  : ACTGAACATCCAAAGTCTATTATTGATGAAACATGCTGGAGTGACGTTGACTTTTGCCGT :537
TrDFRh6  : ACTGAACATCCAAAGTCTATTATTGATGAAACATGCTGGAGTGACGTTGACTTTTGCCGT :537
TrDFRh7  : ACTGAACATCCAAAGTCTATTATTGATGAAACATGCTGGAGTGACGTTGACTTTTGCCGT :537
TrDFRh8  : ACTGAACATCAAAATCAATTGTTGATGAAACATGITGGAGTGACGTTGACTTTTGCCGT :536
TrDFRh9  : ACTGAACATCCAAAGTCTATTATTGATGAAACATGCTGGAGTGACGTTGACTTTTGCCGT :536
TrDFRh10 : ACTGAACATCCAAAGTCTATTATTGATGAAACATGCTGGAGTGACGTTGACTTTTGCCGT :536
TrDFRh11 : ACTGAACACTCAAAAATCAATTGTTGATGAAACATGCTTGGAGTGACGTTGACTTTTGCCGT :535
TrDFRh12 : ACTGAACATCCAAAGTCTATTATTGATGAAACATGCTGGAGTGACGTTGACTTTTGCCGT :535
TrDFRh13 : ACTGAACATCCAAAGTCTATTATTGATGAAACATGCTGGAGTGACGTTGACTTTTGCCGT :532
TrDFRh14 : ACTGAACATCCAAAGTCTATTATTGATGAAACATGCTGGAGTGACGTTGACTTTTGCCGT :492
TrDFRh15 : ACTGAACATCCAAAGTCTATTATTGATGAAACATGCTGGAGTGACGTTGACTTTTGCCGT :134
```

FIGURE 64 (cont)

```
                *         560         *         580         *         600
TrDFRh1  : ACAGTCAACATGACCGGTTCGATGTATTTTGTTTCAAAGACCCTAG--------------- :586
TrDFRh2  : AGAGTCAAAATGACCGGTTGGATGTATTTT-------------------------------- :569
TrDFRh3  : -------------------------------------------------------------- :  -
TrDFRh4  : ANAGTCAAAATGACCGGCTGGATGTATTTTGTTTCAAANACCC------------------- :580
TrDFRh5  : AGAGTCAAGATGACCGGTTGGATGTATTTTGTTTCAAAGACCCT------------------ :581
TrDFRh6  : AGAGTCAAGATGACCGGTTGGATGTATTTTGTTTCAAAGACCCTAGCAGAGCAAG------- :592
TrDFRh7  : AGAGTCAAGATGACCGGTTGGATGTATTTTGTTTCAAAGACCCTAGCAGAGCAAGAAGCT   :597
TrDFRh8  : AGAGTCAAAATGACCGGTTGGATGTATTTTGTTTCAAAGA---------------------- :576
TrDFRh9  : AGAGTCAAGATGACCGGTTGGATGTATTTTGTTTCAAACACCCTAGCAGAG----------- :587
TrDFRh10 : AGAGTCAAGATGACCGGTTGGATGTATTTTGTTTCAAAGACCCTAGCAGAGCAAGAAGCT   :596
TrDFRh11 : AGAGTCAAAATGACCGGTTGGATGTATTTTGTTTCAAAGACCCT------------------ :579
TrDFRh12 : AGAGTCAAGATGACCGGTTGGATCTATTTTGTTTCAAAGACCCTAGCAGAGCAAGAAGCT   :595
TrDFRh13 : AGAGTCAAAATGACCGGTTGGATGTATTTTGTTTCAAAGACCCTAGCAGAGCAG-------- :586
TrDFRh14 : AGAGTCAAAATGACCGGTTGGATGTATTTTGTTTCAAAGACCCTAGCAGAGCAAGAAGCT   :552
TrDFRh15 : AGAGTCAAAATGACCGGTTGGATGTATTTTGTTTCAAAGACCCTAGCAGAGCAAGAAGCT   :194

*         620         *         640         *         660
TrDFRh1  : -------------------------------------------------------------- :  -
TrDFRh2  : -------------------------------------------------------------- :  -
TrDFRh3  : -------------------------------------------------------------- :  -
TrDFRh4  : -------------------------------------------------------------- :  -
TrDFRh5  : -------------------------------------------------------------- :  -
TrDFRh6  : -------------------------------------------------------------- :  -
TrDFRh7  : T------------------------------------------------------------- :598
TrDFRh8  : -------------------------------------------------------------- :  -
TrDFRh9  : -------------------------------------------------------------- :  -
TrDFRh10 : TGGAAGTATTCGAAACAGCACAACATAGATTTTG---------------------------- :630
TrDFRh11 : -------------------------------------------------------------- :  -
TrDFRh12 : TGGAAGTAT----------------------------------------------------- :604
TrDFRh13 : -------------------------------------------------------------- :  -
TrDFRh14 : TGGAAGTATTCGAAAGAGCACAACATAGACTTTG---------------------------- :586
TrDFRh15 : TGGAAGTATTCGAAAGAGCACAACATAGACTTTGTCTCCATCATTCCACCTCTTGTTGTT   :254

*         680         *         700         *         720
TrDFRh1  : -------------------------------------------------------------- :  -
TrDFRh2  : -------------------------------------------------------------- :  -
TrDFRh3  : -------------------------------------------------------------- :  -
TrDFRh4  : -------------------------------------------------------------- :  -
TrDFRh5  : -------------------------------------------------------------- :  -
TrDFRh6  : -------------------------------------------------------------- :  -
TrDFRh7  : -------------------------------------------------------------- :  -
TrDFRh8  : -------------------------------------------------------------- :  -
TrDFRh9  : -------------------------------------------------------------- :  -
TrDFRh10 : -------------------------------------------------------------- :  -
TrDFRh11 : -------------------------------------------------------------- :  -
TrDFRh12 : -------------------------------------------------------------- :  -
TrDFRh13 : -------------------------------------------------------------- :  -
TrDFRh14 : -------------------------------------------------------------- :  -
TrDFRh15 : GGCCCCTTTCTTATGGCCTCAATGCCACCTAGTCTAATCACTGCTCTTTCTCTTATCACA   :314
```

FIGURE 64 (cont)

```
              *         740         *         760         *         780
TrDFRh1  : ------------------------------------------------------------ :  -
TrDFRh2  : ------------------------------------------------------------ :  -
TrDFRh3  : ------------------------------------------------------------ :  -
TrDFRh4  : ------------------------------------------------------------ :  -
TrDFRh5  : ------------------------------------------------------------ :  -
TrDFRh6  : ------------------------------------------------------------ :  -
TrDFRh7  : ------------------------------------------------------------ :  -
TrDFRh8  : ------------------------------------------------------------ :  -
TrDFRh9  : ------------------------------------------------------------ :  -
TrDFRh10 : ------------------------------------------------------------ :  -
TrDFRh11 : ------------------------------------------------------------ :  -
TrDFRh12 : ------------------------------------------------------------ :  -
TrDFRh13 : ------------------------------------------------------------ :  -
TrDFRh14 : ------------------------------------------------------------ :  -
TrDFRh15 : GGAAATGAGGCCCATTACTCAATCATAAAGCAAGGGCAATACGTCCATTTAGATGACCTT :374

*         800         *         820         *         840
TrDFRh1  : ------------------------------------------------------------ :  -
TrDFRh2  : ------------------------------------------------------------ :  -
TrDFRh3  : ------------------------------------------------------------ :  -
TrDFRh4  : ------------------------------------------------------------ :  -
TrDFRh5  : ------------------------------------------------------------ :  -
TrDFRh6  : ------------------------------------------------------------ :  -
TrDFRh7  : ------------------------------------------------------------ :  -
TrDFRh8  : ------------------------------------------------------------ :  -
TrDFRh9  : ------------------------------------------------------------ :  -
TrDFRh10 : ------------------------------------------------------------ :  -
TrDFRh11 : ------------------------------------------------------------ :  -
TrDFRh12 : ------------------------------------------------------------ :  -
TrDFRh13 : ------------------------------------------------------------ :  -
TrDFRh14 : ------------------------------------------------------------ :  -
TrDFRh15 : TGTCTTGCTCATATATTTCTGTATGAGAATCCAAAAGCTCAAGGGAGATACATTTGCTGT :434

*         860         *         880         *         900
TrDFRh1  : ------------------------------------------------------------ :  -
TrDFRh2  : ------------------------------------------------------------ :  -
TrDFRh3  : ------------------------------------------------------------ :  -
TrDFRh4  : ------------------------------------------------------------ :  -
TrDFRh5  : ------------------------------------------------------------ :  -
TrDFRh6  : ------------------------------------------------------------ :  -
TrDFRh7  : ------------------------------------------------------------ :  -
TrDFRh8  : ------------------------------------------------------------ :  -
TrDFRh9  : ------------------------------------------------------------ :  -
TrDFRh10 : ------------------------------------------------------------ :  -
TrDFRh11 : ------------------------------------------------------------ :  -
TrDFRh12 : ------------------------------------------------------------ :  -
TrDFRh13 : ------------------------------------------------------------ :  -
TrDFRh14 : ------------------------------------------------------------ :  -
TrDFRh15 : TCACATGAAGCAACCATTCATCAAGTTGCAAAACTTATTAAAGAAAAATACCCAGAGTTC :494
```

FIGURE 64 (cont)

```
                    *         920         *         940         *         960
TrDFRh1  : ------------------------------------------------------------ : -
TrDFRh2  : ------------------------------------------------------------ : -
TrDFRh3  : ------------------------------------------------------------ : -
TrDFRh4  : ------------------------------------------------------------ : -
TrDFRh5  : ------------------------------------------------------------ : -
TrDFRh6  : ------------------------------------------------------------ : -
TrDFRh7  : ------------------------------------------------------------ : -
TrDFRh8  : ------------------------------------------------------------ : -
TrDFRh9  : ------------------------------------------------------------ : -
TrDFRh10 : ------------------------------------------------------------ : -
TrDFRh11 : ------------------------------------------------------------ : -
TrDFRh12 : ------------------------------------------------------------ : -
TrDFRh13 : ------------------------------------------------------------ : -
TrDFRh14 : ------------------------------------------------------------ : -
TrDFRh15 : AATGTCCCAACAAAATTCAATGATATCCCAGATGAATTGGAAATTATTAAATTTTCTAAA :554

*
TrDFRh1  : ------------------ : -
TrDFRh2  : ------------------ : -
TrDFRh3  : ------------------ : -
TrDFRh4  : ------------------ : -
TrDFRh5  : ------------------ : -
TrDFRh6  : ------------------ : -
TrDFRh7  : ------------------ : -
TrDFRh8  : ------------------ : -
TrDFRh9  : ------------------ : -
TrDFRh10 : ------------------ : -
TrDFRh11 : ------------------ : -
TrDFRh12 : ------------------ : -
TrDFRh13 : ------------------ : -
TrDFRh14 : ------------------ : -
TrDFRh15 : AAGAAGATCACAGACT   : 570
```

FIGURE 64 (cont)

```
                 *        20         *        40         *        60
TrLCRa : GGNCATAAAAACTGCACTAGTGTGTATAAGTTTNTTAGTGAAAAAAGAGTGTGTAAATTA :  60

*        80         *       100         *       120
TrLCRa : ACATCATGGCTAGTATCAAACAAATTGGAAACAAGAAAGCATGTGTGATTGGTGGCACTG : 120

*       140         *       160         *       180
TrLCRa : GTTTTGTTGCATCTATGTTGATCAAACAGTTACTTGAAAAGGGTTATGCTGTTAATACTA : 180

*       200         *       220         *       240
TrLCRa : CTGTTAGAGACCCAGATAGTCCTAAGAAAATATCTCACCTAGTGGCACTGCAAAGTTTGG : 240

*       260         *       280         *       300
TrLCRa : GGGAACTGAATCTATTTAGAGCAGACTTAACAGTTGAAGAAGATTTTGATGCTCCTATAG : 300

*       320         *       340         *       360
TrLCRa : CAGGATGTGAGCTTGTTTTTCAACTTGCTACACCTGTGAACTTTGCTTCTCAAGATCCTG : 360

*       380         *       400         *       420
TrLCRa : AGAATGACATGATAAAGCCAGCAATCAAAGGTGTGTTGAATGTGTTGAAAGCAAGTGCAA : 420

*       440         *       460         *       480
TrLCRa : GAGCAAAAGAAGTCAAAAGAGTTATCTTAACATCTTCGGCAGCCGCGGTGACTATAAATG : 480

*       500         *       520         *       540
TrLCRa : AACTCAAAGGGACAGGTCATGTTATGGATGAAACCAACTGGTCAGATGTTGAATTTCTGA : 540

*       560         *       580         *       600
TrLCRa : ACACTGCAAAGCCACCCACTTGGGGTTATCCTGCTTCAAAAATGCTAGCTGAAAAGGCTG : 600

*       620         *       640         *       660
TrLCRa : CATGGAAATTTGCTGAAGAAAATGACATTGATCTAATCACTGTGATACCTAGTTTAACAA : 660

*       680         *       700         *       720
TrLCRa : CTGGTCCTTCTCTCACACCAGATATCCCATCTAGTGTTGGCTTGGCAATGTCTCTAATAA : 720

*       740         *       760         *       780
TrLCRa : CAGGCAATGATTTCCTCATAAATGCTCTGAAAGGAATGCAATTTCTGTCGGGTTCGTTAT : 780

*       800         *       820         *
TrLCRa : CCATCACTCATGTTGAGGATATTTGCCGAGCTCATATATTTCTGGCAGAGAAG        : 833
```

FIGURE 65

```
              *        20         *        40         *        60
TrLCRa : MASIKQIGNKKACVIGGTGFVASMLIKQLLEKGYAVNTTVRDPDSPKKISHLVALQSLGE :  60

*        80         *       100         *       120
TrLCRa : LNLFRADLTVEEDFDAPIAGCELVFQLATPVNFASQDPENDMIKPAIKGVLNVLKASARA : 120

*       140         *       160         *       180
TrLCRa : KEVKRVILTSSAAAVTINELKGTGHVMDETNWSDVEFLNTAKPPTWGYPASKMLAEKAAW : 180

*       200         *       220         *       240
TrLCRa : KFAEENDIDLITVIPSLTTGPSLTPDIPSSVGLAMSLITGNDFLINALKGMQFLSGSLSI : 240

*
TrLCRa : THVEDICRAHIFLAEK : 256
```

FIGURE 66

```
                    *         20         *         40         *         60
TrLCRa1 : GGNCATAAAAACTGCACTAGTGTGTATAAGTTTNATAGTGAAAAAGAGTGTGTAAATTA :  60
TrLCRa2 : GGNCNTAAAAACTGCACTAGTGTGTATAAGTTTNNTAGTGAAAAAGAGTGTGTAAATTA :  60
TrLCRa3 : -----TAAAAACTGTACTNGTGTGTATAAGTTTNNTAGTGAAAAAGAGTGTGTAAATTA :  55
TrLCRa4 : -----TAAAAACTGCACTAGTGTGTATAAGTTTCTTGGTGAAAAAGAGTTTGTAAATTA :  55
TrLCRa5 : -------------GACCTCGTGTGNANTAGTTTCTTGGTGAAAAAGAGTTTGTAAANTA :  47
TrLCRa6 : ------------------------------------------------------------ :   -
TrLCRa7 : ------------------------------------------------------------ :   -

*         80         *        100         *        120
TrLCRa1 : ACATCATGGCTAGTATCAAACAAATTGGAAACAAGAAAGCATGTGTGATTGGTGGCACTG : 120
TrLCRa2 : ACATCATGGCTAGTATCAAACAAATTGGAAACAAGAAAGCATGTGTGATTGGTGGCACTG : 120
TrLCRa3 : ACATCATGGCTAGTATCAAACAAATTGGAAACAAGAAAGCATGTGTGATTGGTGGCACTG : 115
TrLCRa4 : ACATCATGGCTAGTATCAAACAAATTGGAAACAAGAAAGCATGTGTGATTGGTGGCACTG : 115
TrLCRa5 : ACATCNTGGCTNGTATCAAACAAATTGGAAACAAGAAAGCATGTGTGATTGGTGGCACTG : 107
TrLCRa6 : ------------------------------------------------------------ :   -
TrLCRa7 : ------------------------------------------------------------ :   -

*        140         *        160         *        180
TrLCRa1 : GTTTTGTTGCATCTATGTTGATCAAACAGTTACTTGAAAAGGGTTATGCTGTTAATACTA : 180
TrLCRa2 : GTTTTGTTGCATCTATGTTGATCAAACAGTTACTTGAAAAGGGTTATGCTGTTAATACTA : 180
TrLCRa3 : GTTTTGTTGCATCTATGTTGATCAAACAGTTACTTGAAAAGGGTTATGCTGTTAATACTA : 175
TrLCRa4 : GTTTTGTTGCATCTATGTTGATCAACCAGTTACTTGAAAAGGGTTATGCTGTTAATACTA : 175
TrLCRa5 : GTTTTGTTGCATCTATGTTGATCAACCAGTTACTTGAAAAGGGTTATGCTGTTAATACTA : 167
TrLCRa6 : ------------------------------------------------------------ :   -
TrLCRa7 : ------------------------------------------------------------ :   -

*        200         *        220         *        240
TrLCRa1 : CTGTTAGAGACCCAGATAGTCCTAAGAAAATATCTCACCTAGTGGCACTGCAAAGTTTGG : 240
TrLCRa2 : CTGTTAGAGACCCAGATAGTCCTAAGAAAATATCTCACCTAGTGGCACTGCAAAGTTTGG : 240
TrLCRa3 : CTGTTAGAGACCCAGATAGTCCTAAGAAAATATCTCACCTAGTGCCACTGCAAAGTTTGG : 235
TrLCRa4 : CCGTTAGAGACCCAGATAGCCCTAAGAAAATATCTCACCTAGTGGCACTGCAAAGTTTGG : 235
TrLCRa5 : CCGTTAGAGACCCAGATAGCCCTAAGAAAATATCTCACCTAGTGGCACTGCAAAGTTTGG : 227
TrLCRa6 : ---------------------------------------------------------G :   1
TrLCRa7 : ------------------------------------------------------------ :   -

*        260         *        280         *        300
TrLCRa1 : GGGAACTGAATCTATTTAGAGCAGACTTAACAGTTGAAGAAGATTTTGATGCTCCTATAG : 300
TrLCRa2 : GGGAACTGAATCTATTTAGAGCAGACTTAACAGTTGAAGAAGATTTTGATGCTCCTATAG : 300
TrLCRa3 : GGGAACTGAATCTATTTAGAGCAGACTTAACAGTTGAAGAAGATTTTGATGCTCCTATAG : 295
TrLCRa4 : GGGAACTGAATCTATTTAGAGCAGACTTAACAGTTGAAGAAGATTTTGATGCTCCTATAG : 295
TrLCRa5 : GGGAACTGAATCTATTTAGAGCAGACTTAACAGTTGAAGAAGATTTTGATGCTCCTATAG : 287
TrLCRa6 : NGNACCTGAATCTATTTAGAGNAGACTTAACAGTTGAAGAAGATTTTGATGCTCCTATAG :  61
TrLCRa7 : --------------------------TTAACAGTTGAAGAAGATTTTGATGCTCCTATAG :  34

*        320         *        340         *        360
TrLCRa1 : CAGGATGTGAGCTTGTTTTTCAACTTGCTACACCTGTGAACTTTGCTTCTCAAGATCCTG : 360
TrLCRa2 : CAGGATGTGAGCTTGTTTTTCAACTTGCTACACCTGTGAACTTTGCTTCTCAAGATCCTG : 360
TrLCRa3 : CAGGATGTGAGCTTGTTTTTCAACTTGCTACACCTGTGAACTTTGCTTCTCAAGATCCTG : 355
TrLCRa4 : CAGGATGTGAACTTGTTTTTCAACTTGCTACACCTGTGAACTTTGCTTCTCAAGATCCTG : 355
TrLCRa5 : CAGGATGTGAACTTGTTTTTCAACTTGCTACACCTGTGAACTTTGCTTCTCAAGATCCTG : 347
TrLCRa6 : CAGGATGTGAGCTTGTTTTTCAACTTGCTACACCTGTGACCTTTGCTTCTCAAGATCCTG : 121
TrLCRa7 : CAGGATGTGAGCTTGTTTTTNAACTTGCTACACCTGTGACCTTTGCTTCTCAAGATCCTG :  94
```

FIGURE 67

```
                  *         380         *         400         *         420
TrLCRa1 : AGAATGACATGATAAAGCCAGCAATCAAAGGTGTGTTGAATGTGTTGAAAGCAAGTGCAA : 420
TrLCRa2 : AGAATGACATGATAAAGCCAGCAATCAAAGGTGTGTTGAATGTGTTGAAAGCAAGTGCAA : 420
TrLCRa3 : AGAATGACATGATAAAGCCAGCAATCAAAGGTGTGTTGAATGTGTTGAAAGCAAGTGCAA : 415
TrLCRa4 : AGAATGACATGATAAAGCCAGCAATCAAAGGTGTGTTGAATGTGTTGAAAGCAATTGCAA : 415
TrLCRa5 : AGAATGACATGATAAAGCCAGCAATCAAAGGTGTGTTGAATGTGTTGAAAGCAATTGCAA : 407
TrLCRa6 : AGAATGACATGATAAAGCCAGCAATCAAAGGTGTGTTGAATGTGTTGAAAGCAAGTGCAA : 181
TrLCRa7 : AGAATGACATGATAAAGCCAGCAATCAAAGGTGTGTTGAATGTGTTGAAAGCAAGTGCAA : 154

*         440         *         460         *         480
TrLCRa1 : GAGCAAAAGAAGTCAAAAGAGTTATCTTAACATCTTCGGCAGCCGCGGTGACTATAAATG : 480
TrLCRa2 : GAGCAAAAGAAGTCAAAAGAGTTATCTTAACATCTTCGGCAGCCGCGGTGACTATAAATG : 480
TrLCRa3 : GAGCAAAAGAAGTCAAAAGAGTTATCTTAACATCTTCGGCAGCCGCGGTGACTATAAATG : 475
TrLCRa4 : GAGCAAAAGAAGTTAAAAGAGTTATCTTAACATCTTCGGCAGCCGCGGTGACTATAAATG : 475
TrLCRa5 : GAGCAAAAGAAGTTAAAAGAGTTATCTTAACATCTTCGGCAGCCGCGGTGACTATAAATG : 467
TrLCRa6 : GAGCAAAAGAAGTCAAAAGAGTTATCTTAACATCTTCGGCAGCCGCGGTGACTATAAATG : 241
TrLCRa7 : GAGCAAAAGAAGTCAAAAGAGTTATCTTAACATCTTCGGCAGCCGCGGTGACTATAAATG : 214

*         500         *         520         *         540
TrLCRa1 : AACTCAAAGGGACAGGTCATGTTATGGATGAAACCAACTGGTCAGATGTTGAATTTCTGA : 540
TrLCRa2 : AACTCAAAGGGACAGGTCATGTTATGGATGAAACCAACTGGTCAGATGTTGAATTTCTGA : 540
TrLCRa3 : AACTCAAAGGGACAGGTCATGTTATGGATGAAACCAACTGGTCAGATGTTGAATTTCTGA : 535
TrLCRa4 : AACTCAAAGGGACAGGTCATGTTATGGATGAAACCAACTGGTCTGATGTTGAATTTCTCA : 535
TrLCRa5 : AACTCAAAGGGACAGGTCATGTTATGGATGAAACCAACTGGTCTGATGTTGAATTTCTTA : 527
TrLCRa6 : AACTCAAAGGGACAGGTCATGTTATGGATGAAACCAACTGGTCAGGTGTTGAATTTCTGA : 301
TrLCRa7 : AACTCAAAGGGACAGGTCATGTTATGGATGAAACCAACTGGTCAGATGTTGAATTTCTGA : 274

*         560         *         580         *         600
TrLCRa1 : ACACTGCAAAGCCACCCACTTGGGGTTATCCTGCTT------------------------ : 576
TrLCRa2 : ACACTGCAAAGCCACCCACTTGGGGTTATCCTGCTTCAAN-------------------- : 580
TrLCRa3 : ACACTGCAAAGCCACCCACTTGGGGTTATCCTGCTTCAAAAAT----------------- : 578
TrLCRa4 : ACACTGCAAAGCCACCCACTTGGGGTTATCCTGCTTCAAAAATGCTAGCTGAAAAGGCTG : 595
TrLCRa5 : ACACTGCAAAGCCACCCACTTGGGGTTATCCTGCTTCAAAAATGCTAGCTGAAAAGGCTG : 587
TrLCRa6 : ACACTGCAAAGCCACCCACTTGGGGTTATCCTGCTTCAAAAATGCTAGCTGAAAAGGCTG : 361
TrLCRa7 : ACACTGCAAAGCCACCCACTTGGGGTTATCCTGCTTCAAAAATGCTAGCTGAAAAGGCTG : 334

*         620         *         640         *         660
TrLCRa1 : ------------------------------------------------------------ :   -
TrLCRa2 : ------------------------------------------------------------ :   -
TrLCRa3 : ------------------------------------------------------------ :   -
TrLCRa4 : CATGGAAATTTGCTGAAGAAAATG------------------------------------ : 619
TrLCRa5 : CATGGAAATTTGCTGAAGAAAATGACNTTGAT---------------------------- : 619
TrLCRa6 : CATGGAAATTTGCTGAAGAAAATGACATTGATCTAATCACTGTGATACCTAGTTTAACAA : 421
TrLCRa7 : CATGGAAATTTGCTGAAGAAAATGACATTGATCTAATCACTGTGATACCTAGTTTAACAA : 394

*         680         *         700         *         720
TrLCRa1 : ------------------------------------------------------------ :   -
TrLCRa2 : ------------------------------------------------------------ :   -
TrLCRa3 : ------------------------------------------------------------ :   -
TrLCRa4 : ------------------------------------------------------------ :   -
TrLCRa5 : ------------------------------------------------------------ :   -
TrLCRa6 : CTGGTCCTTCTCTCACACCAGATATCCCATCTAGTGTTGGCTTGGCAATGTCTCTAATAA : 481
TrLCRa7 : CTGGTCCTTCTCTCACACCAGATATCCCATCTAGTGTTGGCTTGGCAATGTCTCTAATAA : 454
```

FIGURE 67 (cont)

```
            *         740         *         760         *         780
TrLCRa1 : ------------------------------------------------------------- :   -
TrLCRa2 : ------------------------------------------------------------- :   -
TrLCRa3 : ------------------------------------------------------------- :   -
TrLCRa4 : ------------------------------------------------------------- :   -
TrLCRa5 : ------------------------------------------------------------- :   -
TrLCRa6 : CAGGCAATGATTTCCTCATAAATGCTCTGAAAGGAATGCAATTTCTGTCGGGTTCGTTAT : 541
TrLCRa7 : CAGGCAATGATTTCCTCATAAATGCTCTGAAAGGAATGCAATTTCTGTCGGGTTCGTTAT : 514

*         800         *         820         *
TrLCRa1 : -------------------------------------------------------- :   -
TrLCRa2 : -------------------------------------------------------- :   -
TrLCRa3 : -------------------------------------------------------- :   -
TrLCRa4 : -------------------------------------------------------- :   -
TrLCRa5 : -------------------------------------------------------- :   -
TrLCRa6 : CCATCACTCATGTTGAGGATATTTGCCGAGCTCATATATTTCTGG-------- : 586
TrLCRa7 : CCATCACTCATGTTGAGGATATTTGCCGAGCTCATATATTTCTGGCAGAGAAG : 567
```

FIGURE 67 (cont)

```
                    *         20         *         40         *         60
TrF3'5'Ha: GGAACCAATTTGTCGGACTTTTTTCCCGGGTTGGCCCGATTCGATTTGCAGGGTGTGGTG : 60

*         80         *        100         *        120
TrF3'5'Ha: AAAGAGATGGATGTCTTGGTTCCACGTTTTGATAGCATATTTGAAAAAATGATTGGTGAA :120

*        140         *        160         *        180
TrF3'5'Ha: CGTAAGAAGAAGGAAGTGGAGGGGAAAGAAAATGAAAGTAAGGATTTTCTGCAGTTTTTG :180

*        200         *        220         *        240
TrF3'5'Ha: TTGAATTTGAAGGATGAGGGTGATTCTAAGACTCCATTCACAATTACCCATGTTAAGGCT :240

*        260         *        280         *        300
TrF3'5'Ha: CTACTCATGGACATGGTTGTGGGTGGATCAGACACATCCTCCAACACAATTGAGTTTGCA :300

*        320         *        340         *        360
TrF3'5'Ha: TTGGCAGAAATGATGAACAACCCAGAAGTAATGAGGAAGGTTCAAGAGGAATTAGAAGAT :360

*        380         *        400         *        420
TrF3'5'Ha: GTAGTTGGGAAAGATAACTTAGTAGAAGAGTCTCACATTCATAAGCTACCCTACTTGCAT :420

*        440         *        460         *        480
TrF3'5'Ha: GCAGTGATGAAAGAAACACTTCGTTTACACCCAGCACTTCCACTTTTAGTCCCTCACTGT :480

*        500         *        520         *        540
TrF3'5'Ha: CCAAGTGAAACCACCAATGTTGGAGGCTACACAATTCCAAAGGGATCTCGTGTGTTTGTG :540

*        560         *        580         *
TrF3'5'Ha: AACGTTTGGGCTATTCATAGAGACCCTTCCATTTGGGAGAAACCACTAGAATTTGAT :597
```

FIGURE 68

```
              *         20         *         40         *         60
TrF3'5'Ha: GTNLSDFFPGLARFDLQGVVKEMDVLVPRFDSIFEKMIGERKKKEVEGKENESKDFLQFL :  60

*         80         *        100         *        120
TrF3'5'Ha: LNLKDEGDSKTPFTITHVKALLMDMVVGGSDTSSNTIEFALAEMMNNPEVMRKVQEELED :120

*        140         *        160         *        180
TrF3'5'Ha: VVGKDNLVEESHIHKLPYLHAVMKETLRLHPALPLLVPHCPSETTNVGGYTIPKGSRVFV :180

*
TrF3'5'Ha: NVWAIHRDPSIWEKPLEFD :199
```

FIGURE 69

```
              *        20         *        40         *        60
TrF3'5'Hb: GNAATCCACNAATCTCTTGAANTAATACCATTTCTTTACAAGAACTTAACCATGGTGATG :  60

*        80         *       100         *       120
TrF3'5'Hb: ATCACTCAATACCAAACCTTCCTTTACAAAGAACTTTCTATATCCTTTTTCATTTTCTTG :120

*       140         *       160         *       180
TrF3'5'Hb: ATAACCCATTTCATCATAAGTTTTCTCTTCAAAAAAAATCTCAAAAAACTTCCACCAGGC :180

*       200         *       220         *       240
TrF3'5'Hb: CCAAAAGGTTTTCCAGTTGTTGGTGCACTCCCACTAATGGGATCCATGCCTCATGTTACC :240

*       260         *       280         *       300
TrF3'5'Hb: CTATTCAAAATGTCACAAAAATATGGTCCCATAATGTACCTAAAAATGGGATCAAATAAC :300

*       320         *       340         *       360
TrF3'5'Hb: ATGGTTGTAGCATCAACTCCTTCTTCAGCCAAAGCATTTCTCAAAACACTTGACCTAAAT :360

*       380         *       400         *       420
TrF3'5'Hb: TTCTCCAATAGACCGCCGAACGCTGGCGCAACTCACCTAGCTTATGATTCACAAGACTTG :420

*       440         *       460         *       480
TrF3'5'Hb: GTTTTCGCCGACTATGGATCTAGGTGGAAATTACTTAGGAAACTAAGTAACTTGCACATG :480

*       500         *       520         *       540
TrF3'5'Hb: CTCGGCGGAAAAGCCCTCGAAAATTGGTCGAAAGTTCGTGAGATTGAAATGGGTCACATG :540

*       560         *       580         *       600
TrF3'5'Hb: ATTCGTACAATGTACGATTGTAGCAAGAAAGACGAATCCGTTGTTGTGGCCGAAATGTTG :600

*       620         *       640         *       660
TrF3'5'Hb: ACATATGCTATGGCCAATATGATAGGTCAAGTTATATTGAGTCGTCGCGTGTTCGAGACA :660

*       680         *       700
TrF3'5'Hb: AAAGGTAGTGACTCAAATGAATTTAAGGATATGGTTGNTG :700
```

FIGURE 70

```
              *        20         *        40         *        60
TrF3'5'Hb:  MVMITQYQTFLYKELSISFFIFLITHFIISFLFKKNLKKLPPGPKGFPVVGALPLMGSMP  : 60

*        80         *       100         *       120
TrF3'5'Hb:  HVTLFKMSQKYGPIMYLKMGSNNMVVASTPSSAKAFLKTLDLNFSNRPPNAGATHLAYDS  :120

*       140         *       160         *       180
TrF3'5'Hb:  QDLVFADYGSRWKLLRKLSNLHMLGGKALENWSKVREIEMGHMIRTMYDCSKKDESVVVA  :180

*       200         *
TrF3'5'Hb:  EMLTYAMANMIGQVILSRRVFETKGSDSNEFKDMVX  :216
```

FIGURE 71

```
                       *        20         *        40         *        60
TrF3'5'Hb1: GNAATCCACNAATCTCTTGAATTAATNCCATTTCTTTACAAGAACTTAACCATGGTGATG  : 60
TrF3'5'Hb2: ------GNCAAATCTCTTGCANTAANNCCATTTCTTTACAAGAACTTAACCATGGTGATG  : 54
TrF3'5'Hb3: -------CNAATCTCTTGAANTNATACCATTTCTTTACAAGAACTTAACCNTGGTGATG  : 52
TrF3'5'Hb4: -----------TCTCTTGNAATNATACCATTTCTTTACAAGAACTTAACCNTGGTGATG  : 48

*        80         *       100         *       120
TrF3'5'Hb1: ATCACTCAATACCAAACCTTCCTTTTCAAAGAACTTTCTATGTCCTTTTTCATTTTCTTG  :120
TrF3'5'Hb2: ATCACTCAACACCAAACCTTCCTTTACAAAGAACTTTCTATATCCTTTTTCATTTTCTTG  :114
TrF3'5'Hb3: ATNNCTCAATACCAAACCTTCCTTTTCAAAGAACTTTCTATGTCCTTTTTCATTTTCTTG  :112
TrF3'5'Hb4: ATNNCTCNATACCAAACCTTCCTTTACAAAGAACTTTCTATATCCTTTTTCATTTTCTTG  :108

*       140         *       160         *       180
TrF3'5'Hb1: ATAACCCGTTTCATCATAAGTTTTCTCTTCAAAAAAAATCTCAAAAAACTTCCACCAGGC  :180
TrF3'5'Hb2: ATAACCCATTTCATCATTAGTTTTCTCTTCAAAAAAAATCTCAAAAAACTTCCACCAGGC  :174
TrF3'5'Hb3: ATAACCCGTTTCATCATAAGTTTTCTCTTCAAAAAAAATCTCAAAAAACTTCCACCAGGC  :172
TrF3'5'Hb4: ATAACCCATTTCATCATTAGTTTTCTCTTCAAAAAAAATCTCAAAAAACTTCCACCAGGC  :168

*       200         *       220         *       240
TrF3'5'Hb1: CCAAAAGGTTTTCCAGTTGTTGGTGCACTCCCACTAATGGGATCCATGCCTCATGTTACC  :240
TrF3'5'Hb2: CCAAAAGGTTTTCCAGTTGTTGGTGCACTCCCACTAATGGGATCCATGCCTCATGTTACC  :234
TrF3'5'Hb3: CCAAAGGGTTTTCCAGTTGTTGGTGCACTCCCACTAATGGGATCCATGCCTCATGTTACC  :232
TrF3'5'Hb4: CCAAAAGGTTTTCCAGTTGTTGGTGCACTCCCACTAATGGGATCCATGCCTCATGTTACC  :228

*       260         *       280         *       300
TrF3'5'Hb1: CTATTCAAAATGTCACAAAAATATGGTCCCATAATGTACCTAAAAATGGGATCAAATAGC  :300
TrF3'5'Hb2: CTATTCAAAATGTCACAAAAATATGGTCCNATAATGTACCTAAAAATGGGATCAAATAAC  :294
TrF3'5'Hb3: CTATTCAAAATGTCACAAAAATATGGTCCCATAATGTACCTAAAAATGGCATCAAATAAC  :292
TrF3'5'Hb4: CTATTCAAAATGTCACAAAAATATGGTCCNATAATGTACCTAAAAATGGGATCAAATAAC  :288

*       320         *       340         *       360
TrF3'5'Hb1: ATGGTTGTAGCATCAACTCCTTCTTCAGCCAAAGCATTTCTCAAAACACTTGACCTAAAT  :360
TrF3'5'Hb2: ATGGTTGTAGCATCAACTCCTTCTTCAGCCAAAGCATTTCTCAAAACACTTGACCTAAAT  :354
TrF3'5'Hb3: ATGGTTGTAGCATCAACTCCTTCTTCAGCCAAAGCATTTCTCAAAACACTTGACCTAAAT  :352
TrF3'5'Hb4: ATGGTTGTAGCATCAACTCCTTCTTCAGCCAAAGCATTTCTCAAAACACTTGACCTAAAT  :348

*       380         *       400         *       420
TrF3'5'Hb1: TTCTCCAATAGACCGCCGAACGCTGGCGCGACTCACCTAGCTTATGATTCACAAGACTTG  :420
TrF3'5'Hb2: TTCTCCAATAGCCCGCCGAACGCTGGCGCAACTCACCTAGCTTATGATCCACAAGACTTG  :414
TrF3'5'Hb3: TTCTCCAATAGACCGCCGAACGCTGGCGCGACTCACCTAGCTTATGATTCACAAGACTTG  :412
TrF3'5'Hb4: TTCTCCAATAGGCCGGCGAACGCTGGCGCAACTCACCTAGCTTATGATTCACAAGACTTG  :408

*       440         *       460         *       480
TrF3'5'Hb1: GTTTTCGCCGACTATGGATCTAGGTGGAAATTACTTAGGAAACTAAGTAACTTGCACATG  :480
TrF3'5'Hb2: GTTTTCGCCGACTATGGATCTAGGTGGAAATTACTTAGGAAACTAAGTAACTTGCACATG  :474
TrF3'5'Hb3: GTTTTCGCCGACTATGGATCTAGGTGGAAATTGCTTAGGAAACTAAGTAACTTGCACATG  :472
TrF3'5'Hb4: GTTTTCGCCGACTATGGATCTAGGTGGAAATTACTTAGGAAACTAAGTAACTTGCACATG  :468

*       500         *       520         *       540
TrF3'5'Hb1: CTCGGCGGAAAAGCCCTCGAAGATTGGTCGAAAGTTCGTGAGATTGAAATGGGTCACATG  :540
TrF3'5'Hb2: CTCGGCGGAAAAGCCCTTGAAAATTGGTCGAAAGTTCGTGAGATTGAAATGGGTCACATG  :534
TrF3'5'Hb3: CTCGGCGGAAAAGCCCTCGAAGATTGGTCGAAAGTTCGCGAGATTGAGATGGGTCACATG  :532
TrF3'5'Hb4: CTCGGCGGAAAAGCCCTTGAAAATTGGTCGAAAGTTCGTGAGATTGAAATGGGTCACATG  :528
```

FIGURE 72

```
                    *         560         *         580         *         600
TrF3'5'Hb1: ATTCGTACAATGTATGATTGTAGCAAGAAAGACGAATCCGTTGT----------------  :584
TrF3'5'Hb2: ATTCGTACAATGTACGATTGTAGCAAGAAAGACGAATCCGTTGTTGTGGCCGAAATGTTG  :594
TrF3'5'Hb3: ATTCGTACAATGTACGATTGTAGCAAGAAAGACGAATATGTTGTTGTC------------  :580
TrF3'5'Hb4: ATTCGTACAATGTACGATTGTAGCAAGAAAGACGAATCCGNTGNTG-------------- : 74

*         620         *         640         *         660
TrF3'5'Hb1: ------------------------------------------------------------ : -
TrF3'5'Hb2: ACATATGCTATGGCCAATATGATAGGTCAAGTTATATTGAGTCGTCGCCTGTTCGAGACA :654
TrF3'5'Hb3: ------------------------------------------------------------ : -
TrF3'5'Hb4: ------------------------------------------------------------ : -

*         680         *         700
TrF3'5'Hb1: --------------------------------------------- : -
TrF3'5'Hb2: AAAGGTAGTGACTCAAATGAATTTAAGGATATGGTTGNTG       :694
TrF3'5'Hb3: --------------------------------------------- : -
TrF3'5'Hb4: --------------------------------------------- : -
```

FIGURE 72 (cont)

```
              *         20         *         40         *         60
TrF3Ha : GCACACNTCTATTTATTTCTACTTAAACCTNACAAAAAATAANACCCACAAAACACAAAC :    60

*         80         *        100         *        120
TrF3Ha : ACCACAAACACCAAAACCGAGTCCGTTTCCTNNTCNAACATGGCACCAAGCCAAACTCTA :   120

*        140         *        160         *        180
TrF3Ha : AGTTATCTCTCACAACAAAACACTCTTGAGTCAAGTTTCGTTAGGGAAGAAGATGAGCGT :   180

*        200         *        220         *        240
TrF3Ha : CCAAAAGTTGCCTACAATAACTTCAGCAACGAGATTCCAATCATTTCTCTTGCTGGAATT :   240

*        260         *        280         *        300
TrF3Ha : GATGAGGTTGATGGTCGTAGAACAGAGATATGTAACAAGATTGTTGAAGCTTGTGAGAAT :   300

*        320         *        340         *        360
TrF3Ha : TGGGGTATTTTTCAGGTTGTTGATCATGGTGTTGATACAAAACTTGTTTCTGAGATGACC :   360

*        380         *        400         *        420
TrF3Ha : CGTTTTGCTAGAGAGTTTTTTGCTTTGCCACCGGAAGAGAAGCTCCGGTTTGACATGTCC :   420

*        440         *        460         *        480
TrF3Ha : GGTGGTAAAAAGGGTGGTTTCATTGTCTCTAGTCATCTCCAAGGAGAAGCAGTGAAGGAT :   480

*        500         *        520         *        540
TrF3Ha : TGGAGAGAGCTAGTGACATATTTTTCATACCCAATTAAACAAAGAGATTATTCAAGGTGG :   540

*        560         *        580         *        600
TrF3Ha : CCAGACAAGCCAGAAGGATGGAAAGAGGTAACAGAAAAATACAGTGAAAACCTAATGAAT :   600

*        620         *        640         *        660
TrF3Ha : TTAGCTTGCAAACTATTGGAAGTTTTATCAGAAGCAATGGGTTTAGAAAAAGAAGCTCTA :   660

*        680         *        700         *        720
TrF3Ha : ACAAAAGCATGTGTTGATATGGATCAAAAAGTTGTTATAAATTATTACCCAAAATGCCCT :   720

*        740         *        760         *        780
TrF3Ha : GAACCTGACCTCACACTTGGCCTTAAACGTCACACTGACCCTGGCACAATTACTCTTTTG :   780
```

FIGURE 73

```
            *       800         *       820         *       840
TrF3Ha : CTTCAAGATCAAGTTGGTGGCCTTCAAGCTACCAAAGATAATGGTAAGACGTGGATTACA :  840

*       860         *       880         *       900
TrF3Ha : GTTCAACCAGTTGAAGGTGCTTTTGTTGTTAATCTTGGAGACCATGGTCACTATCTAAGT :  900

*       920         *       940         *       960
TrF3Ha : AATGGACGGTTCAAAAAATGCTGACCACCAAGCAGTGGTGAATTCGAACTACAGCCGNTTA : 960

*       980         *      1000         *      1020
TrF3Ha : TCAATAGCAACATTTCAAAATCCAGCTCCCGATGCAACTGTATACCCTTTGAAGATTAGA : 1020

*      1040         *      1060         *      1080
TrF3Ha : GAGGGTGAAAAATCTGTGTTGGAAGAACCAATCACTTTTGCTGAAATGTATAGAAGGAAG : 1080

*      1100         *      1120         *      1140
TrF3Ha : ATGACCAAAGACCTTGAAATTGCTAGGATGAAGAAGTTGGCTAAGGAACAACAACTTAGG : 1140

*      1160         *      1180         *      1200
TrF3Ha : GACTTGGAGGAGAACAAGACTAAATATGAGGCCAAACCTTTGAATGAGATCTTTGCTTAA : 1200

*      1220         *      1240         *      1260
TrF3Ha : TTAATTAGTCTTAATTTAAATAATTAATAAATTTTAGACTTAATTTACATATAATAATTT : 1260

TrF3Ha : T : 1261
```

FIGURE 73 (cont)

```
                *          20           *          40           *           6
TrF3Ha : MAPSQTLSYLSQQNTLESSFVREEDERPKVAYNNFSNEIPIISLAGIDEVDGRRTEICNK :  59

*          80           *         100           *         120
TrF3Ha : IVEACENWGIFQVVDHGVDTKLVSEMTRFAREFFALPPEEKLRFDMSGGKKGGFIVSSHL : 120

*         140           *         160           *         180
TrF3Ha : QGEAVKDWRELVTYFSYPIKQRDYSRWPDKPEGWKEVTEKYSENLMNLACKLLEVLSEAM : 180

*         200           *         220           *         240
TrF3Ha : GLEKEALTKACVDMDQKVVINYYPKCPEPDLTLGLKRHTDPGTITLLLQDQVGGLQATKD : 240

*         260           *         280           *         300
TrF3Ha : NGKTWITVQPVEGAFVVNLGDHGHYLSNGRFKNADHQAVVNSNYSXLSIATFQNPAPDAT : 300

*         320           *         340           *         360
TrF3Ha : VYPLKIREGEKSVLEEPITFAEMYRRKMTKDLEIARMKKLAKEQQLRDLEENKTKYEAKP : 360

TrF3Ha : LNEIFA : 366
```

FIGURE 74

```
                    *        20         *        40         *        60
TrF3Ha1  : GCACACNTCTATTTATTTCTACTTAAACCTCACAAAAAATAA-ACCCACAACACACAAAC : 59
TrF3Ha2  : GCACNGNTCTATTTATTTCTACTTAAACCT---NAAAAATAA-ACCCACAA--CAC-AA- : 52
TrF3Ha3  : -CACACNTCTATTTATTTCTACTTAAACCTNACAAAAAATAANACCCACAACACACAAAC : 59
TrF3Ha4  : --TCCCCTCTANTTATTTCTNCTTAAACCTNNCAAAAATNANNACCCACAACACACNAAN : 58
TrF3Ha5  : ------------------------------GTTAACACAC-NCCAACACAAAC        : 22
TrF3Ha6  : --------------------------------GNA-ACCCACAANACACAAAC        : 20
TrF3Ha7  : ------------------------------------CACACNAACNCCAAAC        : 16
TrF3Ha8  : ------------------------------------CACNACNAGCACAAAC        : 16
TrF3Ha9  : ---------------------------------------CCACANGACAC-AA-       : 13
TrF3Ha10 : ---------------------------------------GNANCCCACNAAC        : 13
TrF3Ha11 : ---------------------------------------GNACCACACAAAC        : 13
TrF3Ha12 : ---------------------------------------GCGA--CAC-AA-        :  9
TrF3Ha13 : ----------------------------------------TCTAACACAAAC        : 12
TrF3Ha14 : ----------------------------------------CNCAACACAAAC        : 12
TrF3Ha15 : -----------------------------------------GNNATCACA          : 11
TrF3Ha16 : -----------------------------------------GAACCCACA          : 10
TrF3Ha17 : ------------------------------------------AACCCACG          :  9
TrF3Ha18 : ------------------------------------------GCACNAAC          :  8
TrF3Ha19 : -------------------------------------------AC-ANC           :  5
TrF3Ha20 : -------------------------------------------GCNNCA           :  6
TrF3Ha21 : -------------------------------------------GNACCC           :  6
TrF3Ha22 : --------------------------------------------CAACA           :  5
TrF3Ha23 : --------------------------------------------CACA            :  4
TrF3Ha24 : ---------------------------------------------ACA            :  3
TrF3Ha25 : ---------------------------------------------GCA            :  3
TrF3Ha26 : ----------------------------------------------GC            :  2
TrF3Ha27 : ----------------------------------------------CA            :  2
TrF3Ha28 : ----------------------------------------------GC            :  2
TrF3Ha29 : -----------------------------------------------A            :  1
TrF3Ha30 : ------------------------------------------------            :  -
TrF3Ha31 : ------------------------------------------------            :  -
TrF3Ha32 : ------------------------------------------------            :  -
TrF3Ha33 : ------------------------------------------------            :  -
TrF3Ha34 : ------------------------------------------------            :  -
TrF3Ha35 : ------------------------------------------------            :  -
TrF3Ha36 : ------------------------------------------------            :  -
TrF3Ha37 : ------------------------------------------------            :  -
TrF3Ha38 : ------------------------------------------------            :  -
TrF3Ha39 : ------------------------------------------------            :  -
TrF3Ha40 : ------------------------------------------------            :  -
TrF3Ha41 : ------------------------------------------------            :  -
```

FIGURE 75

```
                            *         80         *        100         *        120
TrF3Ha1  : ACCAAAAACAG-AGGACCGTTTCCATCATC---A--AACATGGCACCAAGCCAAACTCTA :113
TrF3Ha2  : ACCAAAAACAG-AGCACCGTTTCCATCATC---A--AACATGGCACCAAGCCAAACCCTA :106
TrF3Ha3  : ACCAAAAACAGNAGCACCGTTTCCATCATCNNNANNAACATGGCACCAAGCCAAACTCTA :119
TrF3Ha4  : ANCACCAAANANACAGNAGTAGCCGTTTCCATCATCAAACATGGCACCAAGCCAAACTCTA :118
TrF3Ha5  : ACCAAAAACAGNANCACCGTTTCC-A-TNCA-T-CAAACATGGCACCAAGCCAAACTCTA : 78
TrF3Ha6  : A-CTAAAACAG-AG-NCCGTTTCN-TNATC---A--AACATGGCACCAAGCCAAACTCTA : 71
TrF3Ha7  : ACCAAAAACAGNANCACCGTTTCC-A-TNCA-TNCAAACATGGCACCAAGCCAAACTCTA : 73
TrF3Ha8  : ACCAAAAACAGNANCACCGTTTCC-A-TNCA-T-CAAACATGGCACCAAGCCAAACTCTA : 72
TrF3Ha9  : A-CACCAAA-A-ACAGAACCACCGTTTCCATCATCAAACATGGCACCAAGCCAAACTCTA : 70
TrF3Ha10 : ANCANACACNCAAAAANAGAGACCGTTTCCTNNTNNAACATGGCACCAAGCCAAACTCTA : 73
TrF3Ha11 : ACCCAAAACAG-AGCACCGTTTCC-TNATC---A--ACAATGGCACCAAGCCAAACTCTA : 66
TrF3Ha12 : ACC-CAAAC-G-AGC-CCGTTTCC-T-NT----N--AACATGGCACCAAGCCAAACCCTA : 57
TrF3Ha13 : ACCCAAAACAG-AGNACCGTTTCC-TNTCC---A--A-CATGGCACCAAGCCAAACTCTA : 64
TrF3Ha14 : ACCAAAAACAGNANCACCGTTTCC-A-TNCA-TNCAAACATGGCACCAAGCCAAACTCTA : 69
TrF3Ha15 : ACANCAAACNCCANAACGAGTCCGTTTCCTNCTCAACATGGCACCAAGCCAAACTCTA : 71
TrF3Ha16 : ACACCCAAACCCA-AA-CGAGTCCGTTTCCT-NTC-AACATGGCACCAAGCCAAACTCTA : 67
TrF3Ha17 : ACACCANANCCCANAA-CGAGTCCGTTTCCTNNTCNAACATGGCACCAAGCCAAACTCTA : 69
TrF3Ha18 : ANCACAAACNCCGAAANGAGACCGTTTCCTNNTNAACATGGCACCAAGCCAAACTCTA : 68
TrF3Ha19 : A-CTNNACN-C-CAAA-CGAGTCCGTTTCCCT-NT-NAACATGGCACCAAGCCAAACTCTA : 60
TrF3Ha20 : ANCACAAACACCANAAAACGAGCACCGTTTCCTANTNNAACATGGCACCAAGCCAAACTCTA : 66
TrF3Ha21 : ACNCNAACNCCANAA-CGAGTCCGTTTCCTNCTNAACATGGCACCNAGCCAAACTCTA : 66
TrF3Ha22 : ACNNAACNCCA-AA-CGAGNCCGTTTCCT-CTC-AACATGGCACCAAGCCAAACTCTA : 62
TrF3Ha23 : AC-CNCACNCCA-AA-CGAGTCCGTTTCCT-CTN-AACATGGCACCAAGCCAAACTCTA : 60
TrF3Ha24 : AC-CAAAC-CCA-AA-CGAGTCCGTTTCCT-NTC-AACATGGCACCAAGCCAAACTCTA : 58
TrF3Ha25 : AC-CAAAC-CCA-AA-CGAGNCCGTTTCCT-NTC-AACATGGCACCAAGCCAAACTCTA : 59
TrF3Ha26 : NCACANACCAAAA-CGAGNCCGTTTCC--TATCAACATGGCACCAAGCCAAACCCTA : 59
TrF3Ha27 : ACTNCAAACNCCANAAACGAGCCCGTTTCNTNCTCAACATGGCACCAAGCCAAACTCTA : 62
TrF3Ha28 : ACTNCAAACACCANAAACGAGCCCGTTTCCTNNTCNAACATGGCACCAAGCCAAACTCTA : 62
TrF3Ha29 : ACCGAAAACNG-AGNNCCGTTTCN-TNNNN---A--A-CATGCC-CC-AGCCAAACTCTA : 51
TrF3Ha30 : A-CNCCACC-T-NAAACCGAGACCGT-NCCT-NT-NAACATGGCACCAAGCCAAACTCTA : 55
TrF3Ha31 : -GCNNAAACACCANAACGAGCCCGTTTCCTNNTCGAACATGGCACCAAGCCAAACTCTA : 59
TrF3Ha32 : -CAACACNCCCA-AA-CGAGTCCGTTTCCT-NTC-AACATGGCACCAAGCCAAACTCTA : 56
TrF3Ha33 : ----CAAAC-C-AAAACNGAGNCCGTTTCCTA-TN-AACATGGCACCAAGCCAAACTCTA : 52
TrF3Ha34 : -----NACC-C-AAAAC-G-AGNCCGTTTCNTNCTC-AACATGGCTCCTAGCCAAACTCTA : 51
TrF3Ha35 : ------CAACCAAAACNGAGCCGTNTCNNNTNAACATGGCNACCAGCCAAACCCTA : 54
TrF3Ha36 : ------ANCACNACNCGAGNCCGTTTCNTNNTNNAACATGGCNCCNAGCCAAACTCTA : 53
TrF3Ha37 : --------NACCAAANCGAGNCCGTTTCCNNNNTNAACATGGCNCCNAGCCAAACCCTA : 52
TrF3Ha38 : --------NACCAAAANCGAGNCCGTNTTCNNNATNAACATGGCNCCNAGCCAAACCCTA : 52
TrF3Ha39 : ----------------------------------------------------------N :   1
TrF3Ha40 : -----------------------------------------------------------  :   -
TrF3Ha41 : -----------------------------------------------------------  :   -
```

FIGURE 75 (cont)

```
                         *         140         *         160         *         180
TrF3Ha1  : AGTTATCTCTCACAACAAAACACTCTCGAGTCAAGTTTCGTTAGGGAAGAAGATGAGCGT :173
TrF3Ha2  : AGTTATCTCTCACAACAAAAGACTCTTGAGTCAAGTTTCGTTAGGGAAGAAGATGAGCGT :166
TrF3Ha3  : AGTTATCTCTCACAACAAAACACTCTCGAGTCAAGTTTCGTTAGGGAAGAAGATGAGCGT :179
TrF3Ha4  : AGTTATCTCTCACAACAAAACACTCTCGAGTCAAGTTTCGTTAGGGAAGAAGATGAGCGT :178
TrF3Ha5  : AGTTATCTCTCACAACAAAACACTCTTGAGTCAAGTTTCGTTAGGGAAGAAGATGAGCGT :138
TrF3Ha6  : AGTTATCTCTCACAACAAAACACTCTCGAGTCAAGTTTCGTTAGGGAAGAAGATGAGCGT :131
TrF3Ha7  : AGTTATCTCTCACAACAAAACACTCTTGAGTCAACTTTCCTTAGGGAAGAAGATGAGCGT :133
TrF3Ha8  : AGTTATCTCTCACAACAAAACACTCTTGAGTCAAGTTTCGTTAGGGAAGAAGATGAGCGT :132
TrF3Ha9  : AGTTATCTNGACAACAAAACACTCTTGAGTCAAGTTTCGTTACGGAAGAAGATGACCGT :130
TrF3Ha10 : AGTTATCTCTCACAACAAAACACTCTTGAGTCAAGTTTCGTTAGGGAAGAAGATGAGCGT :133
TrF3Ha11 : AGTTATCTCTCACAACAAAACACTCTCGAGTCAAGTTTCGTTAGGGAAGAAGATGAGCGT :126
TrF3Ha12 : AGTTATCTCTC-AACAAAAGACTCTTGAGTCAAGTTTCGTTAGGGAAGAAGATGAGCGT :116
TrF3Ha13 : AGTTATCTCTCACCACAAAACACTCTTGAGTNAAGTTTCGTTAGGGAAGAAGATGAGCGT :124
TrF3Ha14 : AGTTATCTCTCACAACAAAACACTCTTGAGTCAAGTTTCGTTAGGGAAGAAGATGAGCGT :129
TrF3Ha15 : AGTTATCTCTCACAACAAAACACTCTCGAGTCAAGTTTCGTTAGGGAAGAAGATGAGCGT :131
TrF3Ha16 : AGTTATCTCTCACAACAAAACACTCTTGAGTCAAGTTTCGTTAGGGAAGAAGATGAGCGT :127
TrF3Ha17 : AGTTATCTCTCACAACAAAACACTCTCCAGTCAAGTTTCGTTAGGGAAGAAGATGAGCGT :129
TrF3Ha18 : AGTTATCTCTCACAACAAAACACTCTTGAGTCAAGTTTCGTTAGGGAAGAAGATGAGCCT :128
TrF3Ha19 : AGTTATCTCTCACAACAAAACACTCTTGAGTCAAGTTTCGTTAGGGAAGAAGATGAGCGT :120
TrF3Ha20 : AGTTATCTCTCACAACAAAAACCTTGAGTCAAGTTTCGTTAGGGAAGAAGATGAGCGT :126
TrF3Ha21 : AGTTATCTCTNNCAACAAAACACTCTTGAGTCNAGTTTCGTTAGGGAAGAAGATGAGCGT :126
TrF3Ha22 : AGTTATCTCTCACAACAAAACACTCTGGAGTCAAGTTTCGTTAGGGAAGAAGATGAGCGT :122
TrF3Ha23 : AGTTATCTCTC-CAACAAAACACTCTTGAGTCAAGTTTCGTTAGGGAAGAAGATGAGCGT :119
TrF3Ha24 : AGTTATCTCTN-CAACAAAACACTCTTGAGTCAAGTTTCGTTAGGGAAGAAGATGAGCGT :117
TrF3Ha25 : AGTTATCTCTC-CCACAAAACACTCTTGAGTCAAGTTTCGTTAGGGAAGAAGATGAGCGT :118
TrF3Ha26 : AGTTATCTCTCACAAAAAGACTCTTGAGTCAAGTTTCGTTAGGGAAGAAGATGAGCGT :119
TrF3Ha27 : AGTTATCTCTCNCAACAAAACACTCTAGAGTCAAGTTTCGTTAGGGAAGAAGATGAGCGT :122
TrF3Ha28 : AGTTATCTCTCNCAACAAAACACTCTGGAGTCAAGTTTCGTTAGGGAAGAAGATGAGCGT :122
TrF3Ha29 : AGTTATCTCTC-CAACAAAACACTCTGGAGTCAAGTTTCGTTAGGGAAGAAGATGAGCGT :110
TrF3Ha30 : AGTTATCTCTCACAACAAAACACTCTTGAGTCAAGTTTCGTTAGGGAAGAAGATGAGCGT :115
TrF3Ha31 : AGTTATCTCTCACAACAAAACACTCTTGAGTCAAGTTTCGTTAGGGAAGAAGATGAGCGT :119
TrF3Ha32 : AGTTATCTCTCACAACAAAACACTCTTGAGTCAAGTTTCGTTAGGGAAGAAGATGAGCGT :116
TrF3Ha33 : AGTTATCTCTCACAACAAAACCTGGAGTCAAGTTTCGTTAGGGAAGAAGATGAGCGT :112
TrF3Ha34 : AGTTATCTCTC-CCACAAAACACTCTTGAGTCA-GTTTCGTTAGGGAAGAAGATGAGCGT :109
TrF3Ha35 : AGTTATCTCTCACAACAAAAGACTCTTGAGTCNAGTTTCGTTAGGGAAGAAGATGAGCGT :114
TrF3Ha36 : AGTTATCTCTNCAACAAAACACTCTCGAGTCAAGTTTCGTTAGGGAAGAAGATGAGCGT :113
TrF3Ha37 : AGTTATCTCTCACAAAACACTCTTGAGTCAAGTTTCGTTAGGGAAGAAGATGAGCGT :112
TrF3Ha38 : AGTTATCTCTCACAACAAAAGACTCTTGAGTCAAGTTTCGTTAGGGAAGAAGATGAGCGT :112
TrF3Ha39 : NCATNTNTCTNNNACNAAAGNCTCNTGAGTNANGTTTCGTTGGCNANGAAGATGAGCGT : 61
TrF3Ha40 : ------------------------------------------------------------ : -
TrF3Ha41 : ------------------------------------------------------------ : -
```

FIGURE 75 (cont)

```
                     *         200         *         320         *         240
TrF3Ha1  : CCAAAAGTTGCCTACAATAACTTCAGCAACGAGATTCCAATCATTTCTCTTGCTGGAATT :233
TrF3Ha2  : CCAAAAGTTGCCTACAATAACTTCAGCAACGAGATTCCAATCATTTCTCTTGCTGGAATT :226
TrF3Ha3  : CCAAAAGTTGCCTACAATAACTTCAGCAACGAGATTCCAATCATTTCTCTTGCTGGAATT :239
TrF3Ha4  : CCAAAAGTTGCCTACAATAACTTCAGCAACGAGATTCCAATCATTTCTCTTGCTGGAATT :238
TrF3Ha5  : CCAAAAGTTGCCTACAATAACTTCAGCAACGAGATTCCAATCATTTCTCTTGCTGGAATT :198
TrF3Ha6  : CCAAAAGTTGCCTACAATAACTTCAGCAACGAGATTCCAATCATTTCTCTTGCTGGAATT :191
TrF3Ha7  : CCAAAAGTTGCCTACAATAACTTCAGCAACGAGATTCCAATCATTTCTCTTGCTGGAATT :193
TrF3Ha8  : CCAAAAGTTGCCTACAATAACTTCAGCAACGAGATTCCAATCATTTCTCTTGCTGGAATT :192
TrF3Ha9  : CCAAAAGTTGCCTACAATACCTTCAGCACCGAGATTCCAATCNTTTCTCTTGCTGGAATT :190
TrF3Ha10 : CCAAAAGTTGCCTACAATAACTTCAGCAACGAGATTCCAATCATTTCTCTTGCTGGAATT :193
TrF3Ha11 : CCAAAAGTTGCCTACAATAACTTCAGCAACGAGATTCCAATCATTTCTCTTGCTGGAATT :186
TrF3Ha12 : CCAAAAGTTGCCTACAATAACTTCAGCAACGAGATTCCAATCATTTCTCTTGCTGGAATT :176
TrF3Ha13 : CCAAAAGTTGCCTACAATAACTTCAGCAACGAGATTCCAATCATTTCTCTTGCTGGAATT :184
TrF3Ha14 : CCAAAAGTTGCCTACAATAACTTCAGCAACGAGATTCCAATCATTTCTCTTGCTGGAATT :189
TrF3Ha15 : CCAAAAGTTGCCTACAATAACTTCAGCAACGAGATTCCAATCATTTCTCTTGCTGGAATT :191
TrF3Ha16 : CCAAAAGTTGCCTACAATAACTTCAGCAACGAGATTCCAATCATTTCTCTTGCTGGAATT :187
TrF3Ha17 : CCAAAAGTTGCCTACAATAACTTCAGCAACGAGATTCCAATCATTTCTCTTGCTGGAATT :189
TrF3Ha18 : CCAAAAGTTGCCTACAATAACTTCAGCAACGAGATTCCAATCATTTCTCTTGCTGGAATT :188
TrF3Ha19 : CCAAAAGTTGCCTACAATAACTTCAGCAACNAGATTCCAATCATTTCTCTTGCTGGAATT :180
TrF3Ha20 : CCAAAAGTTGCCTACAATAACTTCAGCAACGAGATTCCAATCATTTCTCTTGCTGGAATT :186
TrF3Ha21 : CCAAAAGTTGCCTACAATAACTTCAGCAACGAGATTCCAATCATTTCTCTTGCTGGAATT :186
TrF3Ha22 : CCAAAAGTTGCCTACAATAACTTCAGCAACGAGATTCCAATCATTTCTCTTGCTGGAATT :182
TrF3Ha23 : CCAAAAGTTGCCTACAATAACTTCAGCAACGAGATTCCAATCATTTCTCTTGCTGGAATT :179
TrF3Ha24 : CCAAAAGTTGCCTACAATAACTTCAGCAACGAGATTCCAATCATTTCTCTTGCTGGAATT :177
TrF3Ha25 : CCAAAAGTTGCCTACAATAACTTCAGCAACGAGATTCCAATCATTTCTCTTGCTGGAATT :178
TrF3Ha26 : CCAAAAGTTGCCTACAATAACTTCAGCAACGAGATTCCAATCATTTCTCTTGCTGGAATT :179
TrF3Ha27 : CCAAAAGTTGCCTACAATAACTTCAGCAACGAGATTCCAATCATTTCTCTTGCTGGAATT :182
TrF3Ha28 : CCAAAAGTTGCCTACAATAACTTCAGCAACGAGATTCCAATCATTTCTCTTGCTGGAATT :182
TrF3Ha29 : CCAAAAGTTGCCTACAATAACTTCAGCAACGAGATTCCAATCATTTCTCTTGCTGGAATT :170
TrF3Ha30 : CCAAAAGTTGCCTACAATAACTTCAGCAACGAGATTCCAATCATTTCTCTTGCTGGAATT :175
TrF3Ha31 : CCAAAAGTTGCCTACAATAACTTCAGCAACGAGATTCCAATCATTTCTCTTGCTGGAATT :179
TrF3Ha32 : CCAAAAGTTGCCTACAATAACTTCAGCAACGAGATTCCAATCATTTCTCTTGCTGGAATT :176
TrF3Ha33 : CCAAAAGTTGCCTACAATAACTTCAGCAACGAGATTCCAATCATTTCTCTTGCTGGAATT :172
TrF3Ha34 : CCAAAAGTTGCCTACAATAACTTCAGCAACGAGATTCCAATCATTNCTCTTGCTGGAATT :169
TrF3Ha35 : CCAAAAGTTGCCTACAATAACTTCAGCAACGAGATTCCAATCATTTCTCTTGCTGGAATT :174
TrF3Ha36 : CCAAAAGTTGCCTACAATAACTTCAGCAACGAGATTCCAATCATTTCTCTTGCTGGAATT :173
TrF3Ha37 : CCAAAAGTTGCCTACAATAACTTCAGCAACGAGATTCCAATCATTTCTCTTGCTGGAATT :172
TrF3Ha38 : CCAAAAGTTGCCTACAATAACTTCAGCAACGAGATTCCAATCATTTCTCTTGCTGGAATT :172
TrF3Ha39 : CCAAAAGTTGCCTACAATAACTTCAGCAACGAGATTCCAATNATTTCTCTTGCTGGAATT :121
TrF3Ha40 : ------------------------------------------------------------ :  -
TrF3Ha41 : ------------------------------------------------------------ :  -
```

FIGURE 75 (cont)

```
              *         260         *         280         *         300
TrF3Ha1  : GATGAGGTTGATGGTCGTAGAACAGAGATATGTAACAAGATTGTTGAAGCTTGTGAGAAT :293
TrF3Ha2  : GATGAGGTTGATGGTCGCAGAACAGAGATATGTAACAAGATTGTTGAAGCTTGTGAGAAT :286
TrF3Ha3  : GATGAGGTTGATGGTCGTAGAACAGAGATATGTAACAAGATTGTTGAAGCTTGTGAGAAT :299
TrF3Ha4  : GATGAGGTTGATGGTCGTAGAACAGAGATATGTAACAAGATTGTTGAAGCTTGTGAGAAT :298
TrF3Ha5  : GATGAGGTTGATGGTCGTAGAACAGAGATATGTAACAAGATTGTTGAAGCTTGTGAGAAT :258
TrF3Ha6  : GATGAGGTTGATGGTCGTAGAACAGAGATATGTAACAAGATTGTTGAAGCTTGTGAGAAT :251
TrF3Ha7  : GATGAGGTTGATGGTCGTAGAACAGAGATATGTAACAAGATTGTTGAAGCTTGTGAGAAT :253
TrF3Ha8  : GATGAGGTTGATGGTCGTAGAACAGAGATATGTAACAAGATTGTTGAAGCTTGTGAGAAT :252
TrF3Ha9  : GATGAGGTTGATGGCCGAANAACANANATNTTTACCAAGATTGNCGGGCTTGTNANAAT :250
TrF3Ha10 : GATGAGGTTGATGGNCNGACANCACATGTCNNCCANATTGCTGGAAGCTNCCGANAGN :253
TrF3Ha11 : GATGAGGTTGATGGTCGTAGAACAGAGATATGTAACAAGATTGTTGAAGCTTGTGAGAAT :246
TrF3Ha12 : GATGAGGTTGATGGTCGGAGAACAGAGATATGTAACAAGATTGTTGAAGCTTGTGAGAAT :236
TrF3Ha13 : GATGAGGTTGATGGTCGTAGAACAGAGATATGTAACAAGATTGTTGAAGCTTGTGAGAAT :244
TrF3Ha14 : GATGAGGTTGATGGTCGTAGAACAGAGATATGTAACAAGATTGTTGAAGCTTGTGAGAAT :249
TrF3Ha15 : GATGAGGTTGATGGTCGAAGAACAGAGATATGTAACAAGATTGTTGAAGCTTCTGAGAAT :251
TrF3Ha16 : GATGAGGTTGATGGTCGTAGAACAGAGATATGTAACAAGATTGTTGAAGCTTGTGAGAAT :247
TrF3Ha17 : GATGAGGTTGATGGTCGTAGAACAGAGATATGTAACAAGATTGTTGAAGCTTGTGAGAAT :249
TrF3Ha18 : GATGAGGTTGATGGNNNNGNACNNGNNATGTGGNNAGAGNNGNNNN------------ :236
TrF3Ha19 : GATGAGGTTGATGGTCGNAGAACANAGATATGTAACAAGATTGTTGAAGCTTGTGAGAAT :240
TrF3Ha20 : GATGAGGTTGATGGTCGGAGAACAGAGATATGTAACAAGATTGTTGAAGCTTGTGAGAAT :246
TrF3Ha21 : GATGAGGTTGATGGTCGTAGAACAGAGATATGTAACAAGATTGTTGAAGCTTGTGAGAAT :246
TrF3Ha22 : GATGAGGTTGATGGTCGTAGAACAGAGATATGTAACAAGATTGTTGAAGCTTGTGAGAAT :242
TrF3Ha23 : GATGAGGTTGATGGTCGTAGAACAGAGATATGTAACAAGATTGTTGAAGCTTGTGAGAAT :239
TrF3Ha24 : GATGAGGTTGATGGTCGTAGAACAGAGATATGTAACAAGATTGTTGAAGCTTGTGAGAAT :237
TrF3Ha25 : GATGAGGTTGATGGTCGTAGAACAGAGATATGTAACAAGATTGTTGAAGCTTGTGAGAAT :238
TrF3Ha26 : GATGAGGTTGATGGTCGGAGAACAGAGATATGTAACAAGATTGTTGAAGCTTGTGAGAAT :239
TrF3Ha27 : GATGAGGTTGATGGTCGAAGAACAGAGATATGTAACAAGATTGTTGAAGCTTGTGAGAAT :242
TrF3Ha28 : GATGAGGTTGATGGTCGTAGAACAGAGATATGTAACAAGATTGTTGAAGCTTGTGAGAAT :242
TrF3Ha29 : GATGAGGTTGATGGTCGTAGAACAGAGATATGTAACAAGATTGTTGAAGCTTGTGAGAAT :230
TrF3Ha30 : GATGAGGTTGATGGTCGTAGAACAGAGATATGTAACAAGATTGTTGAAGCTTGTGAGAAT :235
TrF3Ha31 : GATGAGGTTGATGGTCGTAGAACAGAGATATGTAACAAGATTGTTGAAGCTTGTGAGAAT :239
TrF3Ha32 : GATGAGGTTGATGGTCGTAGAACAGAGATATGTAACAAGATTGTTGAAGCTTGTGAGAAT :236
TrF3Ha33 : GATGAGGTTGATGGTCGGAGAACAGAGATATGTAACAAGATTGTTGAAGCTTGTGAGAAT :232
TrF3Ha34 : GATGAGGTTGATGGTCGGAGAACACAGATATGTAACAAGATTGTTGAAGCTTGTGAGAAT :229
TrF3Ha35 : GATGAGGTTGATGGTCGGAGAACAGAGATATGTAACAAGATTGTTGAAGCTTGTGAGAAT :234
TrF3Ha36 : GATGAGGTTGATGGTCGAAGAACACAGATATGTAACAAGATTGTTGAAGCTTGTGAGAAT :233
TrF3Ha37 : GATGAGGTTGATGGTCGCAGAACAGAGATATGTAACAAGATTGTTGAAGCTTGTGAGAAT :232
TrF3Ha38 : GATGAGGTTGATGGTCGCCACAACAGAGATATGTAACAAGATTGTTGAAGCTTGTGAGAAT :232
TrF3Ha39 : GATGAGGTTGATGGTCGGAGAACAGAGATATGTAACAAGATTGTTGAAGCTTGTGAGAAT :181
TrF3Ha40 : -----------------------CTNACNACNNTGTTG-ANCTTGTGAGNAT : 28
TrF3Ha41 : ------------------------------------------------------------ :   -
```

FIGURE 75 (cont)

```
                      *         320         *         340         *         360
TrF3Ha1  : TGGGGTATTTTTTCAGGTTGTTGATCATGGTGTTGATACAAAACTTGTTTCTGAGATGACC :353
TrF3Ha2  : TGGGGTATTTTTTCAGGTTGTTGATCATGGTGTTGATACAAAGCTTGTTTCTGAGATGACT :346
TrF3Ha3  : TGGGGTATTTTTTCAGGTTGTTGATCATGGTGTTGATACAAAACTTGTTTCTGAGATGACC :359
TrF3Ha4  : TGGGGTATTTTTTCAGGTTGTTGATCATGGTGTTGATACAAAACTTGTTTCTGAGATGACC :358
TrF3Ha5  : TGGGGTATTTTTTCAGGTTGTTGATCATGGTGTTGATACAAAACTTGTTTCTGAGATGACC :318
TrF3Ha6  : TGGGGTATTTTTTCAGGTTGTTGATCATGGTGTTGATACAAAACTTGTTTCTGAGATGACC :311
TrF3Ha7  : TGGGGTATTTTTTCAGGTTGTTGATCATGGTGTTGATACAAAACTTGTTTCTGAGATGACC :313
TrF3Ha8  : TGGGGTATTTTTTCAGGTTGTTGATCATGGTGTTGATACAAAACTTGTTTCTGAGATGACC :312
TrF3Ha9  : TGGGGTNTTTTTCAGGTTGGTGATCATGGGGTNNA-ACAAAACTTGTTTCCCANAAANCC :309
TrF3Ha10 : CGCCCTNCCTCNCN---------------------------------------------- :267
TrF3Ha11 : TCCCCTATTTTTCACGTTGTTGATCATGGTGTTGATACAAAACTTGTTTCTGAGATGACC :306
TrF3Ha12 : TGGGGTATTTTTTCAGGTTGTTGATCATGGTGTTGATACAAAGCTTGTTTCTGAGATGACT :296
TrF3Ha13 : TGGGGTATTTTTTCAGGTTGTTGATCATGGTGTTGATACAAAACTTGTTTCTGAGATGACC :304
TrF3Ha14 : TGGGGTATTTTTTCAGGTTGTTGATCATGGTGTTGATACAAAACTTGTTTCTGAGATGACC :309
TrF3Ha15 : TGGGGTATTTTTTCAGGTTGTTGATCATGGTGTTGATACAAAACTTGTTTCTGAGATGACC :311
TrF3Ha16 : TGGGGTATTTTTTCAGGTTGTTGATCATGGTGTTGATACAAAACTTGTTTCTGAGATGACC :307
TrF3Ha17 : TGGGGTATTTTTTCAGGTTGTTGATCATGGTGTTGATACAAAACTTGTTTCTGAGATGACC :309
TrF3Ha18 : ------------------------------------------------------------ :  -
TrF3Ha19 : TGGGGTATTTTTTCANGTTGTTGATCATGGNGTN-------------------------- :273
TrF3Ha20 : TGGGGTATTTTTTCAGGTTGTTGATCATGGTGTTGATACAAAGCTTGTTTCTGAGATGACT :306
TrF3Ha21 : TGGGGTATTTTTTCAGGTTGTTGATCATGGTGTTGATACAAAACTTGTTTCTGAGATGACC :306
TrF3Ha22 : TGGGGTATTTTTTCAGGTTGTTGATCATGGTGTTGATACAAAACTTGTTTCTGAGATGACC :302
TrF3Ha23 : TGGGGTATTTTTTCAGGTTGTTGATCATGGTGTTGATACAAAACTTGTTTCTGAGATGACC :299
TrF3Ha24 : TGGGGTATTTTTTCAGGTTGTTGATCATGGTGTTGATACAAAACTTGTTTCTGAGATGACC :297
TrF3Ha25 : TGGGGTATTTTTTCAGGTTGTTGATCATGGTGTTGATACAAAACTTGTTTCTGAGATGACC :298
TrF3Ha26 : TGGGGTATTTTTTCAGGTTGTTGATCATGGTGTTGATACAAAGCTTGTTTCTGAGATGACT :299
TrF3Ha27 : TGGGGTATTTTTTCAGGTTGTTGATCATGGTGTTGATACAAAACTTGTTTCTGAGATGACC :302
TrF3Ha28 : TGGGGTATTTTTTCAGGTTGTTGATCATGGTGTTGATACAAAACTTGTTTCTGAGATGACC :302
TrF3Ha29 : TGGGGTATTTTTTCAGGTTGTTGATCATGGTGTTGATACAAAACTTGTTTCTGAGATGACC :290
TrF3Ha30 : TGGGGTATTTTTTCAGGTTGTTGATCATGGTGTTGATACAAAACTTGTTTCTGAGATGACC :295
TrF3Ha31 : TGGGGTATTTTTTCAGGTTGTTGATCATGGTGTTGATACAAAACTTGTTTCTGAGATGACC :299
TrF3Ha32 : TGGGGTATTTTTTCAGGTTGTTGATCATGGTGTTGATACAAAACTTGTTTCTGAGATGACC :296
TrF3Ha33 : TGGGGTATTTTTTCAGGTTGTTGATCATGGTGTTGATACAAAGCTTGTTTCTGAGATGACT :292
TrF3Ha34 : TGGGGTATTTTTTCAGGTTGTTGATCATGGTGTTGATACAAANCTTGTTTCTGAGATGACC :289
TrF3Ha35 : TGGGGTATTTTTTCAGGTTGTTGATCATGGTGTTGATACAAAGCTTGTTTCTGAGATGACT :294
TrF3Ha36 : TGGGGTATTTTTTCAGGTTGTTGATCATGGTGTTGATACAAAACTTGTTTCTGAGATGACC :293
TrF3Ha37 : TGGGGTATTTTTTCAGGTTGTTGATCATGGTGTTGATACAAAGCTTGTTTCTGAGATGACT :292
TrF3Ha38 : TGGGGTATTTTTTCAGGTTGTTGATCATGGTGTTGATACAAAGCTTGTTTCTGAGATGACT :292
TrF3Ha39 : TGGGGTATTTTTTCAGGTTGGTGATCATGGTGTTGATACAAAGCTTGTTTCTGAGATGACT :241
TrF3Ha40 : TGGGGTATTTTTTCAGGTTGTTGATCATGGTGTTGATACAAGACTTGTTTCTGAGATGACC : 88
TrF3Ha41 : ------------------------------------------------------------ :  -
```

FIGURE 75 (cont)

```
                          *         380         *         400         *         420
TrF3Ha1  : CGTTTTGCTAGAGAGTTTTTTGCTTTGCCACCGGAAGAGAAGCTCCGGTTTGACATGTCC :413
TrF3Ha2  : CGTTTTGCTAGAGAGTTTTTTGCTTTGCCGCCGGAAGAGAAGCTCCGGTTTGACATGTCC :406
TrF3Ha3  : CGTTTTGCTAGAGAGTTTTTTGCTTTGCCACCGGAAGAGAAGCTCCGGTTTGACATGTCC :419
TrF3Ha4  : CGTTTTGCTAGAGAGTTTTTTGCTTTGCCACCGGAAGAGAAGCTCCGGTTTGACATGTCC :418
TrF3Ha5  : CGTTTTGCTAGAGAGTTTTTTGCTTTGCCACCGGAAGAGAAGCTCCGGTTTGACATGTCC :378
TrF3Ha6  : CGTTTTGCTAGAGAGTTTTTTGCTTTGCCACCGGAAGAGAAGCTCCGGTTTGACATGTCC :371
TrF3Ha7  : CGTTTTGCTAGAGAGTTTTTTGCTTTGCCACCGGAAGAGAAGCTCCGGTTTGACATGTCC :373
TrF3Ha8  : CGTTTTGCTAGAGAGTTTTTTGCTTTGCCACCGGAAGAGAAGCTCCGGTTTGACATGTCC :372
TrF3Ha9  : CNTTTTGNTAAANAGTTTTTTGCTTTNCCCCCGGAANAAAACCTCCGGTTTNACTTNNCC :369
TrF3Ha10 : ------------------------------------------------------------ :  -
TrF3Ha11 : CGTTTTGCTAGAGAGTTTTTTGCTTTGCCACCGGAAGAGAAGCTCCGGTTTGACATGTCC :366
TrF3Ha12 : CGTTTTGCTAGAGAGTTTTTTGCTTTGCCGCCGGAAGAGAAGCTCCGGTTTGACATGTCC :356
TrF3Ha13 : CGTTTTGCTAGAGAGTTTTTTGCTTTGCCACCGGAAGAGAAGCTCCGGTTTGACATGTNC :364
TrF3Ha14 : CGTTTTGCTAGAGAGTTTTTTGCTTTGCCACCGGAAGAGAAGCTCCGGTTTGACATGTCC :369
TrF3Ha15 : CGTTTTGCTAGAGAGTTTTTTGCTTTGCCACCGGAAGAGAAGCTCCGGTTTGACATGTCC :371
TrF3Ha16 : CGTTTTGCTAGAGAGTTTTTTGCTTTGCCACCGGAAGAGAAGCTCCGGTTTGACATGTCC :367
TrF3Ha17 : CGTTTTGCTAGAGAGTTTTTTGCTTTGCCACCGGAAGAGAAGCTCCGGTTTGACATGTCC :369
TrF3Ha18 : ------------------------------------------------------------ :  -
TrF3Ha19 : ------------------------------------------------------------ :  -
TrF3Ha20 : CGTTTTGCTAGAGAGTTTTTTGCTTTGCCGCCGGAAGAGAAGCTCCGGTTTGACATGTCC :366
TrF3Ha21 : CGTTTTGCTAGAGAGTTTTTTGCTTTGCCACCGGAAGAGAAGCTCCGGTTTGACATGTCC :366
TrF3Ha22 : CGTTTTGCTAGAGAGTTTTTTGCTTTGCCACCGGAAGAGAAGCTCCGGTTTGACATGTCC :362
TrF3Ha23 : CGTTTTGCTAGAGAGTTTTTTGCTTTGCCACCGGAAGAGAAGCTCCGGTTTGACATGTCC :359
TrF3Ha24 : CCTTTTGCTACACAGTTTTTTCCTTTGCCACCGGAAGACAAGCTCCGGTTTGACATGTCC :357
TrF3Ha25 : CGTTTTGCTAGAGAGTTTTTTGCTTTGCCACCGGAAGAGAAGCTCCGGTTTGACATGTCC :358
TrF3Ha26 : CGTTTTGCTAGAGAGTTTTTTGCTTTGCCGCCGGAAGAGAAGCTCCGGTTTGACATGTCC :359
TrF3Ha27 : CGTTTTGCTAGAGAGTTTTTTGCTTTGCCACCGGAAGAGAAGCTCCGGTTTGACATGTCC :362
TrF3Ha28 : CGTTTTGCTAGAGAGTTTTTTGCTTTGCCACCGGAAGAGAAGCTCCGGTTTGACATGTCC :362
TrF3Ha29 : CGTTTTGCTAGAGAGTTTTTTGCTTTGCCACCGGAAGAGAAGCTCCGGTTTGACATGTCC :350
TrF3Ha30 : CGTTTTGCTAGAGAGTTTTTTGCTTTGCCACCGGAAGAGAAGCTCCGGTTTGACATGTNC :355
TrF3Ha31 : CGTTTTGCTAGAGACTTTTTTGCTTTGCCACCGGAAGAGAAGCTCCGGTTTGACATGTCC :359
TrF3Ha32 : CGTTTTGCTAGAGAGTTTTTTGCTTTGCCACCGGAAGAGAAGCTCCGGTTTGACATGTCC :356
TrF3Ha33 : CGTTTTGCTAGAGAGTTTTTTGCTTTGCCGCCGGAAGAGAAGCTCCGGTTTGACATGTCC :352
TrF3Ha34 : CGTTTTGCTAGAGAGTTTTTTGCTNTGCCACCGGAAGAGAAGCTCCGGTTTGACATGTCC :349
TrF3Ha35 : CGTTTTGCTAGAGAGTTTTTTGCTTTGCCGCCGGAAGAGAAGCTCCGGTTTGACATGTCC :354
TrF3Ha36 : CGTTTTGCTAGAGAGTTTTTTGCTTTGCCACCGGAAGAGAAGCTCCGGTTTGACATGTCC :353
TrF3Ha37 : CGTTTTGCTAGAGAGTTTTTTGCTTTGCCGCCGGAAGAGAAGCTCCGGTTTGACATGTCC :352
TrF3Ha38 : CGTTTTGCTACACAGTTTTTTGCTTTGCCGCCCCACAGAAGCTCCGGTTTGACATGTCC  :352
TrF3Ha39 : CGTTTTGCTAGAGAGTTTTTTGCTTTGCCGCCGGAAGAGAAGCTCCGGTTTGACATGTCC :301
TrF3Ha40 : CGTTTTGCTAGAGAGTTTTTTGCTTTGCCACCGGAAGAGAAGCTCCGGTTTGACATGTCC :148
TrF3Ha41 : ------------------------------------------------------------ :  -
```

FIGURE 75 (cont)

```
                         *         440         *         460         *         480
TrF3Ha1  : GGTGGTAAAAAGGGTGGTTTCATTGTCTCTAGTCATCTTCAAGGAGAAGCAGTGAAGGAT :473
TrF3Ha2  : GGTGGTAAAAAGGGTGGTTTCATTGTCTCTAGTCATCTCCAAGGAGAAGCAGTGAAAGAT :466
TrF3Ha3  : GGTGGTAAAAAGGGTGGTTTCATTGTCTCTAGTCATCTTCAAGGAGAAGCAGTGAAGGAT :479
TrF3Ha4  : GGTGGTAAAAAGGGTGGNTTNATTGTCTGTANTNGTNTCCNAGGACAACCNGNGNAGGAT :478
TrF3Ha5  : GGTGGTAAAAAGGGTGGTTTCATTGTCTCTAGTCATCTCCAAGGAGAAGCAGTGAAGGAT :438
TrF3Ha6  : GGTGGTAAAAACGGGTGGTTTCATTGTCTCTAGTCATCTCCAAGGAGAAGCAGTGAAGGAT :431
TrF3Ha7  : GGTGGTAAAAAGGGTGGTTTCATTGTCTCTAGTCATCTCCAAGGAGAAGCAGTGAAGGAT :433
TrF3Ha8  : GGTGGTAAAAAGGGTGGTTTCATTGTCTCTAGTCATCTCCAAGGAGAAGCAGTGAAGGAT :432
TrF3Ha9  : GGGGGNAAAAAAGGGGGGGGTTTNATTNGNCNTTAAGNCCCNCCCCAA-GGGANAANCCC :428
TrF3Ha10 : ------------------------------------------------------------ :  -
TrF3Ha11 : GGTGGTAAAAAGGGTGGTTTCATTGTCTCTAGTCATCTTCAAGGAGAAGCAGTGAAGGAT :426
TrF3Ha12 : GGTGGTAAAAAGGGTGGTTTCATTGTCTCTAGTCATCTCCAAGGAGAAGCAGTGAAAGAT :416
TrF3Ha13 : GGTGGTAAAAAGGGTGGTTTCATTGNCTCTAGTCATCTNCAAGGANAAGCANNGAANGAT :424
TrF3Ha14 : GGTGGTAAAAAGGGTGGTTTCATTGTCTCTAGTCATCTCCAAGGAGAAGCAGTGAAGGAT :429
TrF3Ha15 : GGTGGTAAAAAGGGTGGTTTCATTGTCTCTAGTCATCTCCAAGGAGAAGCAGTGAAGGAT :431
TrF3Ha16 : GGTGGTAAAAAGGGTGGTTTCATTGTCTCTAGTCATCTCCAAGGAGAAGCAGTGAAGGAT :427
TrF3Ha17 : GGTGGTAAAAAGGGTGGTTTCATTGTCTCTAGTCATCTTCAACGACAAGCAGTGAAGGAT :429
TrF3Ha18 : ------------------------------------------------------------ :  -
TrF3Ha19 : ------------------------------------------------------------ :  -
TrF3Ha20 : GGTGGTAAAAAGGGTGGTTTCATTGTCTCTAGTCATCTCCAAGGAGAAGCAGTGAAAGAT :426
TrF3Ha21 : GGTGGTAAAAAGGGTGGTTTCATTGTCTCTAGTCATCTCCAAGGAGAAGCAGTGAAGGAT :426
TrF3Ha22 : GGTGGTAAAAAGGGTGGTTTCATTGTCTCTAGTCATCTCCAAGGAGAAGCAGTGAAGGAT :422
TrF3Ha23 : GGTGGTAAAAAGGGTGGTTTCATTGTCTCTAGTCATCTCCAAGGAGAAGCAGTGAAGGAT :419
TrF3Ha24 : GGTGGTAAAAAGGGTGGTTTCATTGTCTCTAGTCATCTCCAAGGAGAAGCAGTGAAGGAT :417
TrF3Ha25 : GGTGGTAAAAAGGGTGGTTTCATTGTCTCTAGTCATCTCCAAGGAGAAGCAGTGAAGGAT :418
TrF3Ha26 : GGTGGTAAAAAGGGTGGTTTCATTGTCTCTAGTCATCTCCAAGGAGAAGCAGTGAAAGAT :419
TrF3Ha27 : GGTGGTAAAAAGGGTGGTTTCATTGTCTCTAGTCATCTCCAAGGAGAAGCAGTGAAGGAT :422
TrF3Ha28 : GGTGGTAAAAAGGGTGGTTTCATTGTCTCTAGTCATCTTCAAGGAGAAGCAGTGAAGGAT :422
TrF3Ha29 : GGTGGTAAAAAGGGTGGTTTCATTGTCTCTAGTCATCTCCAAGGAGAAGCAGTGAAGGAT :410
TrF3Ha30 : GGTGGNAAAAAGGNTGGCTNCANTGCCTNTANCCATCTCCAAGGACAANCACCCNANGAN :415
TrF3Ha31 : GGTGGTAAAAAGGGTGGTTTCATTGTCTCTAGTCATCTCCAAGGAGAAGCAGTGAAGGAT :419
TrF3Ha32 : GGTGGTAAAAAGGGTGGTTTCATTGTCTCTAGTCATCTCCAAGGAGAAGCAGTGAAGGAT :416
TrF3Ha33 : GGTGGTAAAAAGGGTGGTTTCATTGTCTCTAGTCCTCTCCAAGGACAAGCAGTGAANGAT :412
TrF3Ha34 : GGTGGTAAAAAGGGTGGTTTCATTGTCTCTAGTCATCTNCAAGGANAAGCANTGAAGGAT :409
TrF3Ha35 : GGTGGTAAAAAGGGTGGTTTCATTGTCTCTAGTCATCTCCAAGGAGAAGCAGTGAAGGAT :414
TrF3Ha36 : GGTGGTAAAAAGGGTGGTTTCATTGTCTCTAGTCATCTCCAAGGAGAAGCAGTGAAGGAT :413
TrF3Ha37 : GGTGGTAAAAAGGGTGGTTTCATTGTCTCTAGTCATCTCCAAGGAGAAGCAGTGAAAGAT :412
TrF3Ha38 : GGTGGTAAAAAGGGTGGTTTCATTGTCTAGTCATCTCCAAGGAGAAGCAGTGAAAGAT :412
TrF3Ha39 : GGTGGTAAAAAGGGTGGTTTCATTGTCTCTNNTCATCTCCAAGGAGAAGCAGNGAAGGAT :361
TrF3Ha40 : GGTGGTAAAAAGGGTGGTTTCATTGTCTCTAGTCATCTCCAAGGAGAAGCAGTGAAGGAT :208
TrF3Ha41 : ------------------------------------------------------------ :  -
```

FIGURE 75 (cont)

```
               *         500         *         520         *         540
TrF3Ha1  : TGGAGAGAGCTAGTGACATATTTTTCATACCCAATTAAACAAAGAGATTATTCAAGGTGG :533
TrF3Ha2  : TGGAGAGAGCTAGTGACATATTTTTCATACCCAATTAAACAAAGAGATTATTCAAGGTGG :526
TrF3Ha3  : TGGAGAGAGCTAGTGACATATTTTTCATACCCAATTAAACAAAGAGATTATTCAAGGTGC :539
TrF3Ha4  : TGCAGAGAGCTNNN---------------------------------------------- :492
TrF3Ha5  : TGCAGAGAGCTAGTGACATATTTTTCATACCCAATTAAACAAAGAGATTATTCAAGGTGG :498
TrF3Ha6  : TGGAGAGAGCTAGTGACATATTTTTCATACCCAATTAAACAAAGAGATTATTCAAGGTGG :491
TrF3Ha7  : TGGAGAGAGCTAGTGACATATTTTTCATACCCAATTAAACAAAGAGATTATTCAAGGTGG :493
TrF3Ha8  : TGCAGAGAGCTAGTGACATATTTTTCATACCCAATTAAACAAAGAGATTATTCAAGGTGG :492
TrF3Ha9  : ANNNAAG-GNT-TTGGAANANNCNNNN--------------------------------- :453
TrF3Ha10 : ------------------------------------------------------------ : -
TrF3Ha11 : TGGAGAGAGCTAGTGACATATTTTTCATACCCAATTAAACAAAGAGATTATTCAAGGTGG :486
TrF3Ha12 : TGGACGGAGCTAGTGACATATTTTTCATACCCAATTAAACAAAGAGATTATTCAAGGTGG :476
TrF3Ha13 : TGGAGAGAGCTNGNGACATATTTTTN---------------------------------- :450
TrF3Ha14 : TGGAGAGAGCTAGTGACATATTTTTCATACCCAATTAAACAAAGAGATTATTCAAGGTGG :489
TrF3Ha15 : TGCAGAGAGCTAGTGACATATTTTTCATACCCAATTAAACAAAGAGATTATTCAAGGTGG :491
TrF3Ha16 : TGGAGAGAGCTAGTGACATATTTTTCATACCCAATTAAACAAAGAGATTATTCAAGGTGG :487
TrF3Ha17 : TGGAGAGAGCTAGTGACATATTTTTCATACCCAATTAAACAAAGAGATTATTCAAGGTGG :489
TrF3Ha18 : ------------------------------------------------------------ : -
TrF3Ha19 : ------------------------------------------------------------ : -
TrF3Ha20 : TGGAGAGAGCTAGTGACATATTTTTCATACCCAATTAAACAAAGAGATTATTCAAGGTGG :486
TrF3Ha21 : TGGAGAGAGCTAGTGACATATTTTTCATACCCAATTAAACAAAGAGATTATTCAAGGTGG :486
TrF3Ha22 : TGGAGAGAGCTAGTGACATATTTTTCATACCCAATTAAACAAAGACATTATTCAAGGTCC :482
TrF3Ha23 : TGGAGAGAGCTAGTGACATATTTTTCATACCCAATTAAACAAAGAGATTATTCAAGGTGG :479
TrF3Ha24 : TGGAGAGAGCTAGTGACATATTTTTCATACCCAATTAAACAAAGAGATTATTCAAGGTGG :477
TrF3Ha25 : TGGAGAGAGCTAGTGACATATTTTTCATACCCAATTAAACAAAGAGATTATTCAAGGTGG :478
TrF3Ha26 : TGGAGAGAGCTAGTGACATATTTTTCATACCCAATTAAACAAAGAGATTATTCAAGGTGG :479
TrF3Ha27 : TGGAGAGAGCTAGTGACATATTTTTCATACCCAATTAAACAAAGAGATTATTCAAGGTGG :482
TrF3Ha28 : TGGAGAGAGCTAGTGACATATTTTTCATACCCAATTAAACAAAGAGATTATTCAAGGTGG :482
TrF3Ha29 : TGGAGAGAGCTAGTGACATATTTTTCATACCCAATTAAACAAAGAGATTATTCAAGGTGG :470
TrF3Ha30 : TGN--------------------------------------------------------- :418
TrF3Ha31 : TGGAGAGAGCTAGTGACATATTTTTCATACCCAATTAAACAAAGAGATTATTCAAGGTGG :479
TrF3Ha32 : TGGAGAGAGCTAGTGACATATTTTTCATACCCAATTAAATAAAGAGATTATTCAAGGTGG :476
TrF3Ha33 : TGGAGAGAGCTAGTGACATATTTTTCATACCCAATTAAACAAAGAGATTATTCAAGGTGG :472
TrF3Ha34 : TGGAGAGAGCTAGTGACATATTTTTCATACCCAATTAAACAAAGAGATTATTCAAGGTGG :469
TrF3Ha35 : TGGAGGGAGCTAGTGACATATTTTTCATACCCAATTAAACAAAGAGATTATTCAAGGTGG :474
TrF3Ha36 : TGGAGAGAGCTAGTGACATATTTTTCATACCCAATTAAACAAAGAGATTATTCAAGGTGG :473
TrF3Ha37 : TGGAGEGAGCTAGTGACATATTTTTCATACCCAATTAAACAAAGAGATTATTCAAGGTGG :472
TrF3Ha38 : TGGAGAGAGCTAGTGACATATTTTTCATACCCAATTAAACAAAGAGATTATTCAAGGTGG :472
TrF3Ha39 : TGGAGANAGCTAGTGACATATTTNTCATACCCAATTAAACAAAGAGATTATNCAAGGTGG :421
TrF3Ha40 : TGGAGAGAGCTAGTGACATATTTTTCATACCCAATTAAACAAAGAGATTATTCAAGGTGG :268
TrF3Ha41 : ------------------------------------------------------------ : -
```

FIGURE 75 (cont)

```
                    *         560         *         580         *         600
TrF3Ha1  : CCAGACAAGCCAGAAGGATGGAAAGAGGTAACAGAAAAATACAGTGAAAACCT------- :586
TrF3Ha2  : CCAGACAAGCCAGAAGAATGGAAAGAAGTAACAGAAAAATACAGTGAAAACCTAATGAAT :586
TrF3Ha3  : CCAGACAAGCCAGAAGGATGGAAAGAGGTAACAGAAAAATACAGTGAAAACCTAATGAAT :599
TrF3Ha4  : ------------------------------------------------------------ : -
TrF3Ha5  : CCAGACAAGCCAGAAGGATGGAAAGAGGTAACAGAAAAATACAGTGAAAACCTAATGAAT :558
TrF3Ha6  : CCAGACAAGCCAGAAGGATGGAAAGAGGTAACAGAAAAATACAGTGAAAACCTAATGAAT :551
TrF3Ha7  : CCAGACAAGCCAGAAGGATGGAAAGAGGTAACAGAAAAATACAGTGAAAACCTAATGAAT :553
TrF3Ha8  : CCAGACAAGCCAGAAGGATGGAAAGAGGTAACAGAAAAATACAGTGAAAACCTAATGAAT :552
TrF3Ha9  : ------------------------------------------------------------ : -
TrF3Ha10 : ------------------------------------------------------------ : -
TrF3Ha11 : CCAGACAAGCCAGAAGGATGGAAAGAGGTAACAGAAAAATACAGTGAAAACCTAATGAAT :546
TrF3Ha12 : CCAGACAAGCCAGAAGGATGGAAAGAAGTAACAGAAAAATACAGTGAAAACCTAATGAAT :536
TrF3Ha13 : ------------------------------------------------------------ : -
TrF3Ha14 : CCAGACAAGCCAGAAGGATGGAAAGAGGTAACAGAAAAATACAGTGAAAACCTAATGAAT :549
TrF3Ha15 : CCAGACAAGCCAGAAGGATGGAAAGAGGTAACAGAAAAATACAGTGAAAACCTAATGAAT :551
TrF3Ha16 : CCAGACAAGCCAGAAGGATGGAAAGAGGTAACAGAAAAATACAGTGAAAACCTAATGAAT :547
TrF3Ha17 : CCAGACAAGCCAGAAGGATGGAAAGAGGTAACAGAAAAATACAGTGAAAACCTAATGAAT :549
TrF3Ha18 : ------------------------------------------------------------ : -
TrF3Ha19 : ------------------------------------------------------------ : -
TrF3Ha20 : CCAGACAAGCCAGAAGGATGGAAAGAAGTAACAGAAAAATACAGTGAAAACCTAATGAAT :546
TrF3Ha21 : CCAGACAAGCCAGAAGGATGGAAAGAGGTAACAGAAAAATACAGTGAAAACCTAATGAAT :546
TrF3Ha22 : CCAGACAAGCCAGAAGGATGGAAAGAGGTAACAGAAAAATACAGTGAAAACCTAATGAAT :542
TrF3Ha23 : CCAGACAAGCCAGAAGGATGGAAAGACGTAACAGAAAAATACAGTGAAAACCTAATGAAT :539
TrF3Ha24 : CCAGACAAGCCAGAAGGATGGAAAGAGGTAACAGAAAAATACAGTGAAAACCTAATCC-- :535
TrF3Ha25 : CCAGACAAGCCAGAAGGATGGAAAGAGGTAACAGAAAAATACAGTGAAAACCTAATGAAT :538
TrF3Ha26 : CCAGACAAGCCAGAAGGATGGAAAGAAGTAACAGAAAAATACAGTGAAAACCTAATGAAT :539
TrF3Ha27 : CCAGACAAGCCAGAAGGATGGAAAGAGGTAACAGAAAAATACAGTGAAAACCTAATGAAT :542
TrF3Ha28 : CCAGACAAGCCAGAAGGATGGAAAGAGGTAACAGAAAAATACAGTGAAAACCTAATGAAT :542
TrF3Ha29 : CCAGACAAGCCAGAAGGATGGAAAGAGGTAACAGAAAAATACAGTGAAAACCTAATGAAT :530
TrF3Ha30 : ------------------------------------------------------------ : -
TrF3Ha31 : CCAGACAAGCCAGAAGGATGGAAAGAGGTAACAGAAAAATACAGTGAAAACCTAATGAAT :539
TrF3Ha32 : CCAGACAAGCCAGAAGGATGGAAAGAGGTAACAGAAAAATACAGTGAAAACCTAATGAAT :536
TrF3Ha33 : CCAGACAAGCCAGAAGGATGGAAAGAAGTAACANAAAAATACAGTGAAAACCTAATGAAT :532
TrF3Ha34 : CCAGACAAGCCAGAAGGATGGAAAGAGGTNACAGAAAAATACAGCGAAAACCTAATGAAT :529
TrF3Ha35 : CCAGACAAGCCAGAAGGATGGAAAGAGGTAACAGAAAAATACAGTGAAAACCTAATGAAT :534
TrF3Ha36 : CCAGACAAGCCAGAAGGATGGAAAGAGGTAACAGAAAAATACAGTGAAAACCTAATGAAT :533
TrF3Ha37 : CCAGACAAGCCAGAAGGATGGAAAGAAGTAACAGAAAAATACAGTGAAAACCTAATGAAT :532
TrF3Ha38 : CCAGACAAGCCAGAAGGATGGAAAGAAGTAACAGAAAAATACAGTGAAAACCTAATGAAT :532
TrF3Ha39 : TCAGACAAGCCAGAAGGATGGAAAGAAGTAACAGAAAAATACAGTGAAAACCTAATGAAT :481
TrF3Ha40 : CCAGACAAGCCAGAAGGATGGAAAGAGGTAACAGAAAAATACAGTGAAAACCTAATGAAT :328
TrF3Ha41 : ------------------------------------------------------------ : -
```

FIGURE 75 (cont)

```
                     *         620         *         640         *         660
TrF3Ha1   : ----------------------------------------------------------------- :   -
TrF3Ha2   : TTAGCTTGCAG------------------------------------------------------ : 597
TrF3Ha3   : TTAGCT----------------------------------------------------------- : 605
TrF3Ha4   : ----------------------------------------------------------------- :   -
TrF3Ha5   : TTAGCTTGCAAACTATTGGAAGTTTTATCAGAAGCAATGGGTTTAGAAAAAGAAGCTCTA       : 618
TrF3Ha6   : TTAGCTTGCAAGCTATTGGAAG------------------------------------------- : 573
TrF3Ha7   : TTAGCTTGCAAACTATTGGAAGNTTTATCAGAAGCAATGGGTTTAGAAAAAGAAGCTCTA       : 613
TrF3Ha8   : TTAGCTTGCAAACTATTGGAAGTTTTATCAGAAGCAATGGGTTTAGAAAAAGAAGCTCTA       : 612
TrF3Ha9   : ----------------------------------------------------------------- :   -
TrF3Ha10  : ----------------------------------------------------------------- :   -
TrF3Ha11  : TTAGCTTGCAAGCTATTGGAAGTTTTATCAGAAG------------------------------ : 580
TrF3Ha12  : TTAGCTTGCAAGCTATTGGAAGTTTTATCAGAAGCAATGGGATTAGAAAN--------------- : 586
TrF3Ha13  : ----------------------------------------------------------------- :   -
TrF3Ha14  : TTAGCTTGCAAACTATTGGAAGTTTTATCAGAAGCAATGGCTTTAGAAAAAGAAGCTCTA       : 609
TrF3Ha15  : TTAGCTTGCAAACTATTGGAAGTTTTATCAG---------------------------------- : 582
TrF3Ha16  : TTAGCTTGCAAGCTATTGGAAGTTTTATCAGAAGCAATGGGTTTAGAAAAAGAAGCTCTA       : 607
TrF3Ha17  : TTAGCTTGCAAGCTATTGGAAGTTTTATCAGAAGCAATGGGTTN-------------------- : 593
TrF3Ha18  : ----------------------------------------------------------------- :   -
TrF3Ha19  : ----------------------------------------------------------------- :   -
TrF3Ha20  : TTAGCTTGCAAGCTATTGGAAGTTTT--------------------------------------- : 572
TrF3Ha21  : TTAGCTTGCAAACTATTCCAAGTTTTATC------------------------------------ : 575
TrF3Ha22  : TTAGCTTGCAAACTATTGGAAGTTTTATCAGAAGCAATGGGTTTAGAAAAAGAG----------- : 596
TrF3Ha23  : TTAGCTTGCAAACTATTGGAAGTTTTATCAGAAGCAATGGGTTTAGAAAAAGAAGCTCTA       : 599
TrF3Ha24  : ----------------------------------------------------------------- :   -
TrF3Ha25  : TTAGCTTGCAAACTATTGGAN-------------------------------------------- : 559
TrF3Ha26  : TTAGCTTGCAAGCTATTGGAAGTTTT--------------------------------------- : 565
TrF3Ha27  : TTAGCTTGCAAACTATTGGAAGTTTTATCAGAAGCAATGGGTTTAGAAN---------------- : 591
TrF3Ha28  : TTACCTTGCAAGCTATTGGAAGTTTTATCAGAAGCAATGGGTTTAGAAAAAGAAGCTCTA       : 602
TrF3Ha29  : TTAGCTTGCAAGCTATTGGAAGTTTTATCAGAAGCAATGGGTTTAGAAAAAGAAGCTCTA       : 590
TrF3Ha30  : ----------------------------------------------------------------- :   -
TrF3Ha31  : TTAGCTTGCAAACTATTGGAAGTTTTATCAG---------------------------------- : 570
TrF3Ha32  : TTAGCTTGCAAACTATTGGAAGTTTTATCAGAAGCAATGGGTTTAGAAAAAGAAGCTCTA       : 596
TrF3Ha33  : TTANCTTGCAAGCTATTGGAAGTTTTATCACAAGCANTGGGATTACAAAAAGAAGCTGTT       : 592
TrF3Ha34  : TTANCTN---------------------------------------------------------- : 536
TrF3Ha35  : TTAGCTTGCAAGCTATTGGAAGTTTTATCAGAAGCAAT--------------------------- : 572
TrF3Ha36  : TTAGCTTGCAAACTATTGGAAGTTTTATCAGAAGCAATGG------------------------- : 573
TrF3Ha37  : TTAGCTTGCAAGCTATTGGAAGTTTTATCAGAAGCAATGGG------------------------ : 573
TrF3Ha38  : TTACCTTGCAAGCTATTGGAAGTTTTATCAGAAGCAATGGGATTAGAAAAAG------------- : 584
TrF3Ha39  : TTACCTNGCAAGCTATTGGAAGTTTTATNANAANCNATGGNATTAAGA----------------- : 529
TrF3Ha40  : TTAGCTTGCAAACTATTGGAAGTTTTATCAGAAGCAATGGGTTTAGAAAAAGAAGCTCTA       : 388
TrF3Ha41  : ----------------------------------------------------------------- :   -
```

FIGURE 75 (cont)

```
              *         680         *         700         *         720
TrF3Ha1   : ------------------------------------------------------------- :   -
TrF3Ha2   : ------------------------------------------------------------- :   -
TrF3Ha3   : ------------------------------------------------------------- :   -
TrF3Ha4   : ------------------------------------------------------------- :   -
TrF3Ha5   : ACAAAAGCATGTGTTGATATGGATCAAAAAGTTGTTATAAATTATTACCCAAAATGCCCT : 678
TrF3Ha6   : ------------------------------------------------------------- :   -
TrF3Ha7   : ACAAANGCATGTGTTGATATGGATCAAAAAGTTGTTATAAATTATTACCCAAAATGCCCT : 673
TrF3Ha8   : ACAAAAGCATGTGTTGATATGGATCAAAAAGTTGTTATAAATTATTACCCAAAATGCCCT : 672
TrF3Ha9   : ------------------------------------------------------------- :   -
TrF3Ha10  : ------------------------------------------------------------- :   -
TrF3Ha11  : ------------------------------------------------------------- :   -
TrF3Ha12  : ------------------------------------------------------------- :   -
TrF3Ha13  : ------------------------------------------------------------- :   -
TrF3Ha14  : ACAAAAGCATGTGTTGATATGGATCAAAAAGTTGNTATAAATTATTACCCAAAATGCCCT : 669
TrF3Ha15  : ------------------------------------------------------------- :   -
TrF3Ha16  : ACA---------------------------------------------------------- : 610
TrF3Ha17  : ------------------------------------------------------------- :   -
TrF3Ha18  : ------------------------------------------------------------- :   -
TrF3Ha19  : ------------------------------------------------------------- :   -
TrF3Ha20  : ------------------------------------------------------------- :   -
TrF3Ha21  : ------------------------------------------------------------- :   -
TrF3Ha22  : ------------------------------------------------------------- :   -
TrF3Ha23  : ACAAAAGCATGTG------------------------------------------------ : 612
TrF3Ha24  : ------------------------------------------------------------- :   -
TrF3Ha25  : ------------------------------------------------------------- :   -
TrF3Ha26  : ------------------------------------------------------------- :   -
TrF3Ha27  : ------------------------------------------------------------- :   -
TrF3Ha28  : ACAAAAG------------------------------------------------------ : 609
TrF3Ha29  : ACAAAAG------------------------------------------------------ : 597
TrF3Ha30  : ------------------------------------------------------------- :   -
TrF3Ha31  : ------------------------------------------------------------- :   -
TrF3Ha32  : ACAAAAGCATGT------------------------------------------------- : 608
TrF3Ha33  : ACAANANCNT--------------------------------------------------- : 602
TrF3Ha34  : ------------------------------------------------------------- :   -
TrF3Ha35  : ------------------------------------------------------------- :   -
TrF3Ha36  : ------------------------------------------------------------- :   -
TrF3Ha37  : ------------------------------------------------------------- :   -
TrF3Ha38  : ------------------------------------------------------------- :   -
TrF3Ha39  : ------------------------------------------------------------- :   -
TrF3Ha40  : ACAAAAGCATGTGTTGATATGGATCAAAAAGTTGTTATAAATTATTACCCAAAATGCCCT : 448
TrF3Ha41  : ------------------ATCNAAAAGTTGTGATAAANTATTACCCNAAATGCCCT :  38
```

FIGURE 75 (cont)

```
              *       740         *        760         *        780
TrF3Ha1  : ------------------------------------------------------------- :   -
TrF3Ha2  : ------------------------------------------------------------- :   -
TrF3Ha3  : ------------------------------------------------------------- :   -
TrF3Ha4  : ------------------------------------------------------------- :   -
TrF3Ha5  : GAACCTGACCTT------------------------------------------------- : 690
TrF3Ha6  : ------------------------------------------------------------- :   -
TrF3Ha7  : GAACCTGACCTCCCACTT-GCCCTAAACGNCACACTGACCCNGA----------------- : 716
TrF3Ha8  : GAACCTGACCTCACACTTGGCCTTAAACGTCACACTGACCCTGGCACAN------------ : 721
TrF3Ha9  : ------------------------------------------------------------- :   -
TrF3Ha10 : ------------------------------------------------------------- :   -
TrF3Ha11 : ------------------------------------------------------------- :   -
TrF3Ha12 : ------------------------------------------------------------- :   -
TrF3Ha13 : ------------------------------------------------------------- :   -
TrF3Ha14 : GAACCTGACCTC------------------------------------------------- : 681
TrF3Ha15 : ------------------------------------------------------------- :   -
TrF3Ha16 : ------------------------------------------------------------- :   -
TrF3Ha17 : ------------------------------------------------------------- :   -
TrF3Ha18 : ------------------------------------------------------------- :   -
TrF3Ha19 : ------------------------------------------------------------- :   -
TrF3Ha20 : ------------------------------------------------------------- :   -
TrF3Ha21 : ------------------------------------------------------------- :   -
TrF3Ha22 : ------------------------------------------------------------- :   -
TrF3Ha23 : ------------------------------------------------------------- :   -
TrF3Ha24 : ------------------------------------------------------------- :   -
TrF3Ha25 : ------------------------------------------------------------- :   -
TrF3Ha26 : ------------------------------------------------------------- :   -
TrF3Ha27 : ------------------------------------------------------------- :   -
TrF3Ha28 : ------------------------------------------------------------- :   -
TrF3Ha29 : ------------------------------------------------------------- :   -
TrF3Ha30 : ------------------------------------------------------------- :   -
TrF3Ha31 : ------------------------------------------------------------- :   -
TrF3Ha32 : ------------------------------------------------------------- :   -
TrF3Ha33 : ------------------------------------------------------------- :   -
TrF3Ha34 : ------------------------------------------------------------- :   -
TrF3Ha35 : ------------------------------------------------------------- :   -
TrF3Ha36 : ------------------------------------------------------------- :   -
TrF3Ha37 : ------------------------------------------------------------- :   -
TrF3Ha38 : ------------------------------------------------------------- :   -
TrF3Ha39 : ------------------------------------------------------------- :   -
TrF3Ha40 : GAACCTGACCTCACACTTGGCCTTAAACGTCACACTGACCCTGGCACAATTACTCTTTTG : 508
TrF3Ha41 : GAACCTGACCTCACACTTGGCCTTAAACGCACACTGACCCTGGNACAATTACTCTTTTG  :  98
```

FIGURE 75 (cont)

```
                          *         800         *         820         *         840
TrF3Ha1  : ------------------------------------------------------------------ :  -
TrF3Ha2  : ------------------------------------------------------------------ :  -
TrF3Ha3  : ------------------------------------------------------------------ :  -
TrF3Ha4  : ------------------------------------------------------------------ :  -
TrF3Ha5  : ------------------------------------------------------------------ :  -
TrF3Ha6  : ------------------------------------------------------------------ :  -
TrF3Ha7  : ------------------------------------------------------------------ :  -
TrF3Ha8  : ------------------------------------------------------------------ :  -
TrF3Ha9  : ------------------------------------------------------------------ :  -
TrF3Ha10 : ------------------------------------------------------------------ :  -
TrF3Ha11 : ------------------------------------------------------------------ :  -
TrF3Ha12 : ------------------------------------------------------------------ :  -
TrF3Ha13 : ------------------------------------------------------------------ :  -
TrF3Ha14 : ------------------------------------------------------------------ :  -
TrF3Ha15 : ------------------------------------------------------------------ :  -
TrF3Ha16 : ------------------------------------------------------------------ :  -
TrF3Ha17 : ------------------------------------------------------------------ :  -
TrF3Ha18 : ------------------------------------------------------------------ :  -
TrF3Ha19 : ------------------------------------------------------------------ :  -
TrF3Ha20 : ------------------------------------------------------------------ :  -
TrF3Ha21 : ------------------------------------------------------------------ :  -
TrF3Ha22 : ------------------------------------------------------------------ :  -
TrF3Ha23 : ------------------------------------------------------------------ :  -
TrF3Ha24 : ------------------------------------------------------------------ :  -
TrF3Ha25 : ------------------------------------------------------------------ :  -
TrF3Ha26 : ------------------------------------------------------------------ :  -
TrF3Ha27 : ------------------------------------------------------------------ :  -
TrF3Ha28 : ------------------------------------------------------------------ :  -
TrF3Ha29 : ------------------------------------------------------------------ :  -
TrF3Ha30 : ------------------------------------------------------------------ :  -
TrF3Ha31 : ------------------------------------------------------------------ :  -
TrF3Ha32 : ------------------------------------------------------------------ :  -
TrF3Ha33 : ------------------------------------------------------------------ :  -
TrF3Ha34 : ------------------------------------------------------------------ :  -
TrF3Ha35 : ------------------------------------------------------------------ :  -
TrF3Ha36 : ------------------------------------------------------------------ :  -
TrF3Ha37 : ------------------------------------------------------------------ :  -
TrF3Ha38 : ------------------------------------------------------------------ :  -
TrF3Ha39 : ------------------------------------------------------------------ :  -
TrF3Ha40 : CTTCAAGATCAAGTTGGTGGTCTTCAAGCTACCAAAGATAATGGTAAGACGTGGATTACA :568
TrF3Ha41 : CTTCAAGATCAAGTTGGTGGCCTTCAAGCTACCAAAGATAATGCTAAGACGTGGATTACA :158
```

FIGURE 75 (cont)

```
              *         860         *         880         *         900
TrF3Ha1  : ---------------------------------------------------------------- :  -
TrF3Ha2  : ---------------------------------------------------------------- :  -
TrF3Ha3  : ---------------------------------------------------------------- :  -
TrF3Ha4  : ---------------------------------------------------------------- :  -
TrF3Ha5  : ---------------------------------------------------------------- :  -
TrF3Ha6  : ---------------------------------------------------------------- :  -
TrF3Ha7  : ---------------------------------------------------------------- :  -
TrF3Ha8  : ---------------------------------------------------------------- :  -
TrF3Ha9  : ---------------------------------------------------------------- :  -
TrF3Ha10 : ---------------------------------------------------------------- :  -
TrF3Ha11 : ---------------------------------------------------------------- :  -
TrF3Ha12 : ---------------------------------------------------------------- :  -
TrF3Ha13 : ---------------------------------------------------------------- :  -
TrF3Ha14 : ---------------------------------------------------------------- :  -
TrF3Ha15 : ---------------------------------------------------------------- :  -
TrF3Ha16 : ---------------------------------------------------------------- :  -
TrF3Ha17 : ---------------------------------------------------------------- :  -
TrF3Ha18 : ---------------------------------------------------------------- :  -
TrF3Ha19 : ---------------------------------------------------------------- :  -
TrF3Ha20 : ---------------------------------------------------------------- :  -
TrF3Ha21 : ---------------------------------------------------------------- :  -
TrF3Ha22 : ---------------------------------------------------------------- :  -
TrF3Ha23 : ---------------------------------------------------------------- :  -
TrF3Ha24 : ---------------------------------------------------------------- :  -
TrF3Ha25 : ---------------------------------------------------------------- :  -
TrF3Ha26 : ---------------------------------------------------------------- :  -
TrF3Ha27 : ---------------------------------------------------------------- :  -
TrF3Ha28 : ---------------------------------------------------------------- :  -
TrF3Ha29 : ---------------------------------------------------------------- :  -
TrF3Ha30 : ---------------------------------------------------------------- :  -
TrF3Ha31 : ---------------------------------------------------------------- :  -
TrF3Ha32 : ---------------------------------------------------------------- :  -
TrF3Ha33 : ---------------------------------------------------------------- :  -
TrF3Ha34 : ---------------------------------------------------------------- :  -
TrF3Ha35 : ---------------------------------------------------------------- :  -
TrF3Ha36 : ---------------------------------------------------------------- :  -
TrF3Ha37 : ---------------------------------------------------------------- :  -
TrF3Ha38 : ---------------------------------------------------------------- :  -
TrF3Ha39 : ---------------------------------------------------------------- :  -
TrF3Ha40 : GTTCAACCAGTTGAAGGTGCTTTTGTTGTTAATCTTGGAGACCATGGTCACTATCTAAGT :628
TrF3Ha41 : GTTCAACCAGTTGAAGGTGCTTTTGTTGTTAATCTTGGAGACCATGGTCATTATCTAAGT :218
```

FIGURE 75 (cont)

```
                        *         920         *         940         *         960
TrF3Ha1   : ------------------------------------------------------------------ :   -
TrF3Ha2   : ------------------------------------------------------------------ :   -
TrF3Ha3   : ------------------------------------------------------------------ :   -
TrF3Ha4   : ------------------------------------------------------------------ :   -
TrF3Ha5   : ------------------------------------------------------------------ :   -
TrF3Ha6   : ------------------------------------------------------------------ :   -
TrF3Ha7   : ------------------------------------------------------------------ :   -
TrF3Ha8   : ------------------------------------------------------------------ :   -
TrF3Ha9   : ------------------------------------------------------------------ :   -
TrF3Ha10  : ------------------------------------------------------------------ :   -
TrF3Ha11  : ------------------------------------------------------------------ :   -
TrF3Ha12  : ------------------------------------------------------------------ :   -
TrF3Ha13  : ------------------------------------------------------------------ :   -
TrF3Ha14  : ------------------------------------------------------------------ :   -
TrF3Ha15  : ------------------------------------------------------------------ :   -
TrF3Ha16  : ------------------------------------------------------------------ :   -
TrF3Ha17  : ------------------------------------------------------------------ :   -
TrF3Ha18  : ------------------------------------------------------------------ :   -
TrF3Ha19  : ------------------------------------------------------------------ :   -
TrF3Ha20  : ------------------------------------------------------------------ :   -
TrF3Ha21  : ------------------------------------------------------------------ :   -
TrF3Ha22  : ------------------------------------------------------------------ :   -
TrF3Ha23  : ------------------------------------------------------------------ :   -
TrF3Ha24  : ------------------------------------------------------------------ :   -
TrF3Ha25  : ------------------------------------------------------------------ :   -
TrF3Ha26  : ------------------------------------------------------------------ :   -
TrF3Ha27  : ------------------------------------------------------------------ :   -
TrF3Ha28  : ------------------------------------------------------------------ :   -
TrF3Ha29  : ------------------------------------------------------------------ :   -
TrF3Ha30  : ------------------------------------------------------------------ :   -
TrF3Ha31  : ------------------------------------------------------------------ :   -
TrF3Ha32  : ------------------------------------------------------------------ :   -
TrF3Ha33  : ------------------------------------------------------------------ :   -
TrF3Ha34  : ------------------------------------------------------------------ :   -
TrF3Ha35  : ------------------------------------------------------------------ :   -
TrF3Ha36  : ------------------------------------------------------------------ :   -
TrF3Ha37  : ------------------------------------------------------------------ :   -
TrF3Ha38  : ------------------------------------------------------------------ :   -
TrF3Ha39  : ------------------------------------------------------------------ :   -
TrF3Ha40  : AATGGACGGTTCAAAAATGCTGACCATCAAGCAGTGGTGAATTCGAACTACAGCCGNTTA : 688
TrF3Ha41  : AATGGACGGTTCAAAAATGCTGACCACCAAGCAGTGGTGAATTCGAACTACAGCCGTTTA : 278
```

FIGURE 75 (cont)

```
                     *       980       *      1000       *      1020
TrF3Ha1  : ------------------------------------------------------- :  -
TrF3Ha2  : ------------------------------------------------------- :  -
TrF3Ha3  : ------------------------------------------------------- :  -
TrF3Ha4  : ------------------------------------------------------- :  -
TrF3Ha5  : ------------------------------------------------------- :  -
TrF3Ha6  : ------------------------------------------------------- :  -
TrF3Ha7  : ------------------------------------------------------- :  -
TrF3Ha8  : ------------------------------------------------------- :  -
TrF3Ha9  : ------------------------------------------------------- :  -
TrF3Ha10 : ------------------------------------------------------- :  -
TrF3Ha11 : ------------------------------------------------------- :  -
TrF3Ha12 : ------------------------------------------------------- :  -
TrF3Ha13 : ------------------------------------------------------- :  -
TrF3Ha14 : ------------------------------------------------------- :  -
TrF3Ha15 : ------------------------------------------------------- :  -
TrF3Ha16 : ------------------------------------------------------- :  -
TrF3Ha17 : ------------------------------------------------------- :  -
TrF3Ha18 : ------------------------------------------------------- :  -
TrF3Ha19 : ------------------------------------------------------- :  -
TrF3Ha20 : ------------------------------------------------------- :  -
TrF3Ha21 : ------------------------------------------------------- :  -
TrF3Ha22 : ------------------------------------------------------- :  -
TrF3Ha23 : ------------------------------------------------------- :  -
TrF3Ha24 : ------------------------------------------------------- :  -
TrF3Ha25 : ------------------------------------------------------- :  -
TrF3Ha26 : ------------------------------------------------------- :  -
TrF3Ha27 : ------------------------------------------------------- :  -
TrF3Ha28 : ------------------------------------------------------- :  -
TrF3Ha29 : ------------------------------------------------------- :  -
TrF3Ha30 : ------------------------------------------------------- :  -
TrF3Ha31 : ------------------------------------------------------- :  -
TrF3Ha32 : ------------------------------------------------------- :  -
TrF3Ha33 : ------------------------------------------------------- :  -
TrF3Ha34 : ------------------------------------------------------- :  -
TrF3Ha35 : ------------------------------------------------------- :  -
TrF3Ha36 : ------------------------------------------------------- :  -
TrF3Ha37 : ------------------------------------------------------- :  -
TrF3Ha38 : ------------------------------------------------------- :  -
TrF3Ha39 : ------------------------------------------------------- :  -
TrF3Ha40 : TCAATAGCAA--------------------------------------------- :698
TrF3Ha41 : TCAATAGCAACATTTCAAAATCCAGCTCCCGATGCAACTGTATACCCTTTGAAGATTAGA :338
```

FIGURE 75 (cont)

```
              *        1040         *        1060         *        1080
TrF3Ha1  : ------------------------------------------------------------ :  -
TrF3Ha2  : ------------------------------------------------------------ :  -
TrF3Ha3  : ------------------------------------------------------------ :  -
TrF3Ha4  : ------------------------------------------------------------ :  -
TrF3Ha5  : ------------------------------------------------------------ :  -
TrF3Ha6  : ------------------------------------------------------------ :  -
TrF3Ha7  : ------------------------------------------------------------ :  -
TrF3Ha8  : ------------------------------------------------------------ :  -
TrF3Ha9  : ------------------------------------------------------------ :  -
TrF3Ha10 : ------------------------------------------------------------ :  -
TrF3Ha11 : ------------------------------------------------------------ :  -
TrF3Ha12 : ------------------------------------------------------------ :  -
TrF3Ha13 : ------------------------------------------------------------ :  -
TrF3Ha14 : ------------------------------------------------------------ :  -
TrF3Ha15 : ------------------------------------------------------------ :  -
TrF3Ha16 : ------------------------------------------------------------ :  -
TrF3Ha17 : ------------------------------------------------------------ :  -
TrF3Ha18 : ------------------------------------------------------------ :  -
TrF3Ha19 : ------------------------------------------------------------ :  -
TrF3Ha20 : ------------------------------------------------------------ :  -
TrF3Ha21 : ------------------------------------------------------------ :  -
TrF3Ha22 : ------------------------------------------------------------ :  -
TrF3Ha23 : ------------------------------------------------------------ :  -
TrF3Ha24 : ------------------------------------------------------------ :  -
TrF3Ha25 : ------------------------------------------------------------ :  -
TrF3Ha26 : ------------------------------------------------------------ :  -
TrF3Ha27 : ------------------------------------------------------------ :  -
TrF3Ha28 : ------------------------------------------------------------ :  -
TrF3Ha29 : ------------------------------------------------------------ :  -
TrF3Ha30 : ------------------------------------------------------------ :  -
TrF3Ha31 : ------------------------------------------------------------ :  -
TrF3Ha32 : ------------------------------------------------------------ :  -
TrF3Ha33 : ------------------------------------------------------------ :  -
TrF3Ha34 : ------------------------------------------------------------ :  -
TrF3Ha35 : ------------------------------------------------------------ :  -
TrF3Ha36 : ------------------------------------------------------------ :  -
TrF3Ha37 : ------------------------------------------------------------ :  -
TrF3Ha38 : ------------------------------------------------------------ :  -
TrF3Ha39 : ------------------------------------------------------------ :  -
TrF3Ha40 : ------------------------------------------------------------ :  -
TrF3Ha41 : GAGGGTGAAAAATCTGTGTTGGAAGAACCAATCACTTTTGCTGAAATGTATAGAAGGAAG :398
```

FIGURE 75 (cont)

```
              *      1100       *      1120       *      1140
TrF3Ha1  : ------------------------------------------------------ : -
TrF3Ha2  : ------------------------------------------------------ : -
TrF3Ha3  : ------------------------------------------------------ : -
TrF3Ha4  : ------------------------------------------------------ : -
TrF3Ha5  : ------------------------------------------------------ : -
TrF3Ha6  : ------------------------------------------------------ : -
TrF3Ha7  : ------------------------------------------------------ : -
TrF3Ha8  : ------------------------------------------------------ : -
TrF3Ha9  : ------------------------------------------------------ : -
TrF3Ha10 : ------------------------------------------------------ : -
TrF3Ha11 : ------------------------------------------------------ : -
TrF3Ha12 : ------------------------------------------------------ : -
TrF3Ha13 : ------------------------------------------------------ : -
TrF3Ha14 : ------------------------------------------------------ : -
TrF3Ha15 : ------------------------------------------------------ : -
TrF3Ha16 : ------------------------------------------------------ : -
TrF3Ha17 : ------------------------------------------------------ : -
TrF3Ha18 : ------------------------------------------------------ : -
TrF3Ha19 : ------------------------------------------------------ : -
TrF3Ha20 : ------------------------------------------------------ : -
TrF3Ha21 : ------------------------------------------------------ : -
TrF3Ha22 : ------------------------------------------------------ : -
TrF3Ha23 : ------------------------------------------------------ : -
TrF3Ha24 : ------------------------------------------------------ : -
TrF3Ha25 : ------------------------------------------------------ : -
TrF3Ha26 : ------------------------------------------------------ : -
TrF3Ha27 : ------------------------------------------------------ : -
TrF3Ha28 : ------------------------------------------------------ : -
TrF3Ha29 : ------------------------------------------------------ : -
TrF3Ha30 : ------------------------------------------------------ : -
TrF3Ha31 : ------------------------------------------------------ : -
TrF3Ha32 : ------------------------------------------------------ : -
TrF3Ha33 : ------------------------------------------------------ : -
TrF3Ha34 : ------------------------------------------------------ : -
TrF3Ha35 : ------------------------------------------------------ : -
TrF3Ha36 : ------------------------------------------------------ : -
TrF3Ha37 : ------------------------------------------------------ : -
TrF3Ha38 : ------------------------------------------------------ : -
TrF3Ha39 : ------------------------------------------------------ : -
TrF3Ha40 : ------------------------------------------------------ : -
TrF3Ha41 : ATGACCAAAGACCTTGAAATTGCTAGGATGAAGAAGTTGGCTAAGCAACAACAACTTAGG : 458
```

FIGURE 75 (cont)

```
                     *       1160        *       1180         *        1200
TrF3Ha1  : ------------------------------------------------------------ : -
TrF3Ha2  : ------------------------------------------------------------ : -
TrF3Ha3  : ------------------------------------------------------------ : -
TrF3Ha4  : ------------------------------------------------------------ : -
TrF3Ha5  : ------------------------------------------------------------ : -
TrF3Ha6  : ------------------------------------------------------------ : -
TrF3Ha7  : ------------------------------------------------------------ : -
TrF3Ha8  : ------------------------------------------------------------ : -
TrF3Ha9  : ------------------------------------------------------------ : -
TrF3Ha10 : ------------------------------------------------------------ : -
TrF3Ha11 : ------------------------------------------------------------ : -
TrF3Ha12 : ------------------------------------------------------------ : -
TrF3Ha13 : ------------------------------------------------------------ : -
TrF3Ha14 : ------------------------------------------------------------ : -
TrF3Ha15 : ------------------------------------------------------------ : -
TrF3Ha16 : ------------------------------------------------------------ : -
TrF3Ha17 : ------------------------------------------------------------ : -
TrF3Ha18 : ------------------------------------------------------------ : -
TrF3Ha19 : ------------------------------------------------------------ : -
TrF3Ha20 : ------------------------------------------------------------ : -
TrF3Ha21 : ------------------------------------------------------------ : -
TrF3Ha22 : ------------------------------------------------------------ : -
TrF3Ha23 : ------------------------------------------------------------ : -
TrF3Ha24 : ------------------------------------------------------------ : -
TrF3Ha25 : ------------------------------------------------------------ : -
TrF3Ha26 : ------------------------------------------------------------ : -
TrF3Ha27 : ------------------------------------------------------------ : -
TrF3Ha28 : ------------------------------------------------------------ : -
TrF3Ha29 : ------------------------------------------------------------ : -
TrF3Ha30 : ------------------------------------------------------------ : -
TrF3Ha31 : ------------------------------------------------------------ : -
TrF3Ha32 : ------------------------------------------------------------ : -
TrF3Ha33 : ------------------------------------------------------------ : -
TrF3Ha34 : ------------------------------------------------------------ : -
TrF3Ha35 : ------------------------------------------------------------ : -
TrF3Ha36 : ------------------------------------------------------------ : -
TrF3Ha37 : ------------------------------------------------------------ : -
TrF3Ha38 : ------------------------------------------------------------ : -
TrF3Ha39 : ------------------------------------------------------------ : -
TrF3Ha40 : ------------------------------------------------------------ : -
TrF3Ha41 : GACTTGGAGGAGAACAAGACTAAATATGAGGCCAAACCTTTGAATGAGATCTTTGCTTAA  :518
```

FIGURE 75 (cont)

```
              *         1220         *         1240         *         1260
TrF3Ha1  : ------------------------------------------------------------ : -
TrF3Ha2  : ------------------------------------------------------------ : -
TrF3Ha3  : ------------------------------------------------------------ : -
TrF3Ha4  : ------------------------------------------------------------ : -
TrF3Ha5  : ------------------------------------------------------------ : -
TrF3Ha6  : ------------------------------------------------------------ : -
TrF3Ha7  : ------------------------------------------------------------ : -
TrF3Ha8  : ------------------------------------------------------------ : -
TrF3Ha9  : ------------------------------------------------------------ : -
TrF3Ha10 : ------------------------------------------------------------ : -
TrF3Ha11 : ------------------------------------------------------------ : -
TrF3Ha12 : ------------------------------------------------------------ : -
TrF3Ha13 : ------------------------------------------------------------ : -
TrF3Ha14 : ------------------------------------------------------------ : -
TrF3Ha15 : ------------------------------------------------------------ : -
TrF3Ha16 : ------------------------------------------------------------ : -
TrF3Ha17 : ------------------------------------------------------------ : -
TrF3Ha18 : ------------------------------------------------------------ : -
TrF3Ha19 : ------------------------------------------------------------ : -
TrF3Ha20 : ------------------------------------------------------------ : -
TrF3Ha21 : ------------------------------------------------------------ : -
TrF3Ha22 : ------------------------------------------------------------ : -
TrF3Ha23 : ------------------------------------------------------------ : -
TrF3Ha24 : ------------------------------------------------------------ : -
TrF3Ha25 : ------------------------------------------------------------ : -
TrF3Ha26 : ------------------------------------------------------------ : -
TrF3Ha27 : ------------------------------------------------------------ : -
TrF3Ha28 : ------------------------------------------------------------ : -
TrF3Ha29 : ------------------------------------------------------------ : -
TrF3Ha30 : ------------------------------------------------------------ : -
TrF3Ha31 : ------------------------------------------------------------ : -
TrF3Ha32 : ------------------------------------------------------------ : -
TrF3Ha33 : ------------------------------------------------------------ : -
TrF3Ha34 : ------------------------------------------------------------ : -
TrF3Ha35 : ------------------------------------------------------------ : -
TrF3Ha36 : ------------------------------------------------------------ : -
TrF3Ha37 : ------------------------------------------------------------ : -
TrF3Ha38 : ------------------------------------------------------------ : -
TrF3Ha39 : ------------------------------------------------------------ : -
TrF3Ha40 : ------------------------------------------------------------ : -
TrF3Ha41 : TTAATTAGTCTTAATTTAAATAATTAATAAATTTTAGACTTAATTTACATATAATAATTT :578
```

FIGURE 75 (cont)

```
TrF3Ha1   : - :  -
TrF3Ha2   : - :  -
TrF3Ha3   : - :  -
TrF3Ha4   : - :  -
TrF3Ha5   : - :  -
TrF3Ha6   : - :  -
TrF3Ha7   : - :  -
TrF3Ha8   : - :  -
TrF3Ha9   : - :  -
TrF3Ha10  : - :  -
TrF3Ha11  : - :  -
TrF3Ha12  : - :  -
TrF3Ha13  : - :  -
TrF3Ha14  : - :  -
TrF3Ha15  : - :  -
TrF3Ha16  : - :  -
TrF3Ha17  : - :  -
TrF3Ha18  : - :  -
TrF3Ha19  : - :  -
TrF3Ha20  : - :  -
TrF3Ha21  : - :  -
TrF3Ha22  : - :  -
TrF3Ha23  : - :  -
TrF3Ha24  : - :  -
TrF3Ha25  : - :  -
TrF3Ha26  : - :  -
TrF3Ha27  : - :  -
TrF3Ha28  : - :  -
TrF3Ha29  : - :  -
TrF3Ha30  : - :  -
TrF3Ha31  : - :  -
TrF3Ha32  : - :  -
TrF3Ha33  : - :  -
TrF3Ha34  : - :  -
TrF3Ha35  : - :  -
TrF3Ha36  : - :  -
TrF3Ha37  : - :  -
TrF3Ha38  : - :  -
TrF3Ha39  : - :  -
TrF3Ha40  : - :  -
TrF3Ha41  : T : 579
```

FIGURE 75 (cont)

```
                  *        20         *        40         *        60
TrF3Hb : GNAGCATAACATAAACCCTGTNCCCGATTNATGTAACACAATCTCCCCTTTTCTTATTAC :  60

*        80         *       100         *       120
TrF3Hb : AAGTAAAATACCATAACACAATAATATGAATACCATAATCTTGAATCATACAAACAACCT : 120

*       140         *       160         *       180
TrF3Hb : TGGATCAAACAAAACAACAACCATGGTTGATCTAGAAACAGAACCAAGTTCACCATTTAT : 180

*       200         *       220         *       240
TrF3Hb : TCAATCCCCAGAACACAGACCAAAATCCTCAATAATCATTGCTGAAGGTATCCCTCTAAT : 240

*       260         *       280         *       300
TrF3Hb : TGATCTCACTCCTATAAACTACAAAGATGAAATCATCACCAACCCACTTTCCATTGAAGA : 300

*       320         *       340         *       360
TrF3Hb : CTTAGTCAAAGAAATAGGCAAAGCATGTAAAGAATGGGGTTTCTTTCAAGTGATTAATCA : 360

*       380         *       400         *       420
TrF3Hb : CAAAGTTCCTTTGGATAAACGTGAAAGGATTGAAGAATCTTCAAAGAAGTTTTTTGAACT : 420

*       440         *       460         *       480
TrF3Hb : TAGTTTGGAGGAAAAACTTAAGGTGAGAAGAGATGAAGTTAATTTGCTTGGTTATTTTGA : 480

*       500         *       520         *       540
TrF3Hb : AGCTGAGCATACAAAAAATGTTAGGGACTGGAAGGAAATTTATGATTTAATGTGCAACA : 540

*       560         *       580         *       600
TrF3Hb : ACCAACTTTTATACCACCTTCGGATGACCAAAGTTTTCAGTTTCAATGGGAAAATCGATG : 600

TrF3Hb : G : 601
```

FIGURE 76

```
              *         20         *         40         *         60
TrF3Hb : MNTIILNHTNNLGSNKTTTMVDLETEPSSPFIQSPEHRPKSSIIIAEGIPLIDLTPINYK :  60

*         80         *        100         *        120
TrF3Hb : DEIITNPLSIEDLVKEIGKACKEWGFFQVINHKVPLDKRERIEESSKKFFELSLEEKLKV : 120

*        140         *        160         *
TrF3Hb : RRDEVNLLGYFEAEHTKNVRDWKEIYDFNVQQPTFIPPSDDQSFQFQWENRW : 172
```

FIGURE 77

```
              *         20         *         40         *         60
TrF3Hc : TTACCCAACAATNATGTGTGACTGATGTTAGTGTACCAGGAAAGATGGGAGAGGTGGATC : 60

*         80         *        100         *        120
TrF3Hc : CAGCTTTCTTCAAATCCAGAAAATAGGCCAAAACTTTCCATAATCCAAGCTGAAGGAATT : 120

*        140         *        160         *        180
TrF3Hc : CCTGTAATCAATCTCTCCCCATTAATTCACCACACAGTTCAAGACTCCTCTGCCATTGAA : 180

*        200         *        220         *        240
TrF3Hc : AGCTTAGTCAAAGAAATAGGAAATGCTTGCAAGGAATGGGGTTTCTTCCAAGTAACAAAC : 240

*        260         *        280         *        300
TrF3Hc : CATGGTGTCCCTCTAAATCTAAGGCTCAGACTCGAGGAAGCTACCAAAGTTTTCTTTGCA : 300

*        320         *        340         *        360
TrF3Hc : CAGAGTTTGGAGGAGAAGAGGAAGCTTACCGTAGATGATAACAGTTTGCCTGGTTATCAT : 360

*        380         *        400         *        420
TrF3Hc : GATACAGAGCACACCAAGAATGTCAGAGACTGGAAAGAAGTGTTTGATTTTTTATCCAAA : 420

*        440         *        460         *        480
TrF3Hc : GACCCCACTTTGATTCCTCTGAATTCTGATGAACATGATGATCGAGTCACTCAATGGACT : 480

*        500         *        520         *        540
TrF3Hc : AATCCATCCCCTCAATATCCTCCAAACTTCAAAGTTATTTTGGAAGAGTATATTAAAGAG : 540

*        560         *        580
TrF3Hc : ATGGAAAAGCTAGGCTTTAAGTTGCTAGAGCTTATAGCTTTGAGC : 585
```

FIGURE 78

```
                    *         20         *         40         *         60
TrF3Hc : MLVYQERWERWIQLSSNPENRPKLSIIQAEGIPVINLSPLIHHTVQDSSAIESLVKEIGN :  60

*         80         *        100         *        120
TrF3Hc : ACKEWGFFQVTNHGVPLNLRLRLEEATKVFFAQSLEEKRKLTVDDNSLPGYHDTEHTKNV : 120

*        140         *        160         *        180
TrF3Hc : RDWKEVFDFLSKDPTLIPLNSDEHDDRVTQWTNPSPQYPPNFKVILEEYIKEMEKLGFKL : 180

TrF3Hc : LELIALS : 187
```

FIGURE 79

```
                      *        20         *        40         *        60
TrF3'Ha : GGGAATGGTGGAGGCGAATGTGACCCTAGGGCTGATGAATTAGTAATGGTAGTTGAGCTT : 60

*        80         *       100         *       120
TrF3'Ha : ATGGCGTTAGCTGGAGTTTTCAATATTGGTGATTTTGTTCCTGCTTTGGAATGGTTAGAT :120

*       140         *       160         *       180
TrF3'Ha : ATTCAAGGTGTACAAGGAAAAATGAAGAAATTACATAAAAGATTTGATGCATTTTTAACT :180

*       200         *       220         *       240
TrF3'Ha : AGCATTATTGAAGATCACATGATTTCCAAGAGTGAGAAGCATAATGACTTATTGAGTACG :240

*       260         *       280         *       300
TrF3'Ha : TTGTTATCACTAAAAGAAAAAGTTGATGAGGATGGTGACAAACTTAATGATACTGAGATC :300

*       320         *       340         *       360
TrF3'Ha : AAAGCATTACTCTTGAACATGTTCACAGCTGGAACAGACACATCATCAAGCACAACAGAG :360

*       380         *       400         *       420
TrF3'Ha : TGGGCTATTGCTGAACTAATAAAAAATCCAAAACTAATGATTCGTGTTCAAAATGAGTTG :420

*       440         *       460         *       480
TrF3'Ha : GACACTGTTGTGGGCCGAGACAAGCTTGTAACTGAACAAGACTTGGCCCATCTTCCTTAC :480

*       500         *       520         *       540
TrF3'Ha : TTAGAGGCTGTAATAAAGGAGACATTTCGTCTCCATCCATCAACCCCTCTTTCTCTCCCA :540

*       560         *       580         *       600
TrF3'Ha : CGTGTTGCAACAAATAGTTGTGAAATCCTCGACTATCACATTCCCAAAGGTGCAACTCTC :600

TrF3'Ha : TTGG : 604
```

FIGURE 80

```
              *        20         *        40         *        60
TrF3'Ha : GNGGGECDPRADELVMVVELMALAGVFNIGDFVPALEWLDIQGVQGKMKKLHKRFDAFLT : 60

*        80         *       100         *       120
TrF3'Ha : SIIEDHMISKSEKHNDLLSTLLSLKEKVDEDGDKLNDTEIKALLLNMFTAGTDTSSSTTE :120

*       140         *       160         *       180
TrF3'Ha : WAIAELIKNPKLMIRVQNELDTVVGRDKLVTEQDLAHLPYLEAVIKETFRLHPSTPLSLP :180

*       200
TrF3'Ha : RVATNSCEILDYHIPKGATLL :201
```

FIGURE 81

```
              *         20         *         40         *         60
TrF3'Ha1 : GGGAATCGTGGAGGCGAATGTCACCCTAGGGCTGATGAATTTAAGTAATGGTAGTTGAGC : 60
TrF3'Ha2 : ---AATGGTGGAGGCGAATGTCACCCTAGGGCTGATGAATTTAAGTAATGGTAGTTGAGC : 57

*         80         *        100         *        120
TrF3'Ha1 : TTATGGCGTTAGCTGGAGTTTTCAATATTGGTGATTTTGTTCCTGCTTTGGAATGGTTAG :120
TrF3'Ha2 : TTATGGCGTTAGCTGGAGTTTTCAATATTGGTGATTTTGTTCCTGCTTTGGAATGGTTAG :117

*        140         *        160         *        180
TrF3'Ha1 : ATATTCAAGGTGTACAAGGAAAAATGAAGAAATTACATAAAAGATTTGATGCATTTTTAA :180
TrF3'Ha2 : ATATTCAAGGTGTACAAGGAAAAATGAAGAAATTACATAAAAGATTTGATGCATTTTTAA :177

*        200         *        220         *        240
TrF3'Ha1 : CTAGCATTATTGAAGATCACATGATTTCCAAGAGTGAGAAGCATAATGACTTATTGAGTA :240
TrF3'Ha2 : CTAGCATTATTGAAGATCACATGATTTCCAAGAGTGAGAAGCATAATGACTTATTGAGTA :237

*        260         *        280         *        300
TrF3'Ha1 : CGTTGTTATCACTAAAAGAAAAAGTTGATGAGGATGGTGACAAACTTAATGATACTGAGA :300
TrF3'Ha2 : CGTTGTTATCACTAAAAGAAAAAGTTGATGAGGATGGTGACAAACTTAATGATACTGAGA :297

*        320         *        340         *        360
TrF3'Ha1 : TCAAAGCATTACTCTTGAACATGTTCACAGCTGGAACAGAGACACATCATCAAGCACAACAG :360
TrF3'Ha2 : TCAAAGCATTACTCTTGAACATGTTCACAGCTGGAACAGAGACACATCATCAAGCACAACAG :357

*        380         *        400         *        420
TrF3'Ha1 : AGTGGGCTATTGCTGAACTAATAAAAAATCCAAAACTAATGATTCGTGTTCAAAATGAGT :420
TrF3'Ha2 : AGTGGGCTATTGCTGAACTAATAAAAAATCCAAAACTAATGATTCGTGTTCAAAATGAGT :417

*        440         *        460         *        480
TrF3'Ha1 : TGGACACTGTTGTGGGCCGAGACAAGCTTGTAACTGAACAAGACTTGGCCCATCTTCCTT :480
TrF3'Ha2 : TGGACACTGTTGTGGGCCGAGACAAGCTTGTAACTGAACAAGACTTGGCCCATCTTCCTT :477

*        500         *        520         *        540
TrF3'Ha1 : ACTTAGAGGCTGTAATAAAGGAGACATTTCGTCTCCATCCATCAACCCCTCTTTCTCTCC :540
TrF3'Ha2 : ACTTAGAGGCTGTAATAAAGGAGACATTTCGTCTCCATCCATCAACCCCTCTTTCTCTCC :537

*        560         *        580         *        600
TrF3'Ha1 : CACGTGTTGCAACAAATAGTTGTGAAATCCTCGACTATCAC------------------ :581
TrF3'Ha2 : CACGTGTTGCAACAAATAGTTGTGAAATCCTCGACTATCACATTCCCAAAGGTGCAACTC :597

TrF3'Ha1 : ------ : -
TrF3'Ha2 : TCTTGG :603
```

FIGURE 82

```
                *         20         *         40         *         60
TrPALa : GNAGGAAATTTCAACTAAATATTGCCTTTAATTCTTTNTNATANATNTTTGAATTTCNTT : 60

*         80         *        100         *        120
TrPALa : CTCCCTAAAAATTCTATAGCTACCACATCANCACAACATAACANNAATTAAGAAATATTN : 120

*        140         *        160         *        180
TrPALa : TATNTACTATTTTAAGATATGGAAGTAGTAGCAGCAGCAATCACAAAAAACAATGGCAAG : 180

*        200         *        220         *        240
TrPALa : ATTGATTCATTTTGCTTGAATCATGCTAATGCTAATAACATGAAAGTGAATGGTGCTGAT : 240

*        260         *        280         *        300
TrPALa : CCTTTGAATTGGGGTGTGGCTGCTGAGGCAATGAAGGGAAGTCACTTGGATGAGGTGAAG : 300

*        320         *        340         *        360
TrPALa : CGTATGGTGGAGGAATACCGGAAACCGGTTGTCCGTCTTGGTGGCGAGACACTGACGATT : 360

*        380         *        400         *        420
TrPALa : TCTCAGGTGGCTGCCATTGCTGCACACGATGGTGCAACGGTGGAGCTATCGGAATCTGCT : 420

*        440         *        460         *        480
TrPALa : AGAGCCGGCGTTAAGGCGAGCAGTGACTGGGTTATGGAGAGTATGAACAAAGGTACAGAC : 480

*        500         *        520         *        540
TrPALa : AGTTATGGTGTCACTACAGGGTTCGGCGCTACCTCGCACCGCCGAACCAAACAAGGTGGT : 540

*        560         *        580         *        600
TrPALa : GCTTTGCAGAAAGAGCTCATAAGGTNTTTTGAATGCAGGAATATTTGGAAATGGAACNTG : 600

*        620
TrPALa : AGACAAAGCCACACACTACCC : 621
```

FIGURE 83

```
              *        20         *        40         *        60
TrPALa : MEVVAAAITKNNGKIDSFCLNHANANNMKVNGADPLNWGVAAEAMKGSHLDEVKRMVEEY :  60

*        80         *       100         *       120
TrPALa : RKPVVRLGGETLTISQVAAIAAHDGATVELSESARAGVKASSDWVMESMNKGTDSYGVTT : 120

*       140         *
TrPALa : GFGATSHRRTKQGGALQKELIRFECRNIWKWNRQSHTLP : 159
```

FIGURE 84

```
             *        20         *        40         *        60
TrPALa1 : GNNGGAAATTNCAACTAAATATTGCCTTTAATTCTTTNTNATANATNTTTGAATTTCCTT :  60
TrPALa2 : GNAGGAAATTACAACTAAATATTNCCTTTAATTCTTTATNATANATNTTTGAATTTCNTT :  60
TrPALa3 : ----------TCAAGAAATTACACTCTTTNNTTCTTTNTNATNTTTGTTTNATTTCNTT :  50

*        80         *       100         *       120
TrPALa1 : CTCCCTAAAAATTCTATAGCTACCACATCANCACAACATAACANNAATTAAGAAATATTN :120
TrPALa2 : CTCCCTAAAAATTCTATAGCTACCACATCANCACAACATAACANNAATTAAGAAATATTN :120
TrPALa3 : CTCNCTNGAAATACTATAGTTACCANANCATAACAAAGTAACACTTATTACTAGGTATTA :110

*       140         *       160         *       180
TrPALa1 : TATNTACTATTTTAAGATATGGAAGTAGTAGCANCAGCAATCACAAAAAACAATGGCAAG :180
TrPALa2 : TATNTACTATNTTAAGATATGGAAGTAGTAGCAGCAGCAATCACAAAAAACAATGGCAAG :180
TrPALa3 : TNTGTANGANTTAAGNNATGGAAGTAGTAGCAGCAGCAATCACAAAAAACAACGGAAAG :170

*       200         *       220         *       240
TrPALa1 : ATTGATTCATTTTGCTTGAATCATCCTAATCCTAATAACATCAAACTGAATCGTCCTGAT :240
TrPALa2 : ATTGATTCATTTTGCTTGAATCATGCTAATGCTAATAACATGAAAGTGAATGGTGCTGAT :240
TrPALa3 : ATTGATTCATTTTGCTTGAATCATGCTAATGCTAATAACATGAAAGTGAATGGTGCTGAT :230

*       260         *       280         *       300
TrPALa1 : CCTTTGAATTGGGGTGTGGCTGCTGAGGCAATGAAGGGAAGTCACTTGGATGAGGTGAAG :300
TrPALa2 : CCTTTGAATTGGGGTGTGGCTGCTGAGGCAATGAAGGGAAGTCACTTGGATGAGGTGAAG :300
TrPALa3 : CCTTTGAATTGGGGTGTGGCTGCTGAGGCAATGAAAGGAAGTCACTTGGATGAGGTGAAG :290

*       320         *       340         *       360
TrPALa1 : CGTATGGTGGAGGAATACCGGAAACCGGTTGTCCGTCTTGGTGGCGAGACGCTGACGATT :360
TrPALa2 : CGTATGGTGGAGGAATACCGGAAACCGGTTGTCCGTCTTGGTGGCGAGACACTAACGATT :360
TrPALa3 : NGTATGGTGGAGGANTANCGNAAACCGGTTGTCCGTCTTGGTGGCGAGACACTGACGATT :350

*       380         *       400         *       420
TrPALa1 : TCTCAGGTGGCTGCCATTGCTGCACACGATGGTGCAACGGTGGANCTATCGGAATCTGCT :420
TrPALa2 : TCTCAGGTGGCTGCCATTGCTGCACACGATGGTGCAACGGTGGAGCTATCGGAATCTGCT :420
TrPALa3 : TCTCANGTGGCTGCCATTGCTGCACACGATGGTGCNACGGTGGAGCTATCGGAATCTGCT :410

*       440         *       460         *       480
TrPALa1 : AGAGCCGGCGTTAAGGCGAGCAGTGACTGGGTTATGGAGAGNATGAACAAAGGTACAGAC :480
TrPALa2 : AGAGCCGGCGTTAAGGCNAGCAGTGACTGGGTTATGGAGAGTATGAACAAAGGTACCGAC :480
TrPALa3 : AGAGCCGGCGTTAAGGCGAGCAGTGACTGGGTTATGGANAGTATGAACAAAGGTACTGAC :470

*       500         *       520         *       540
TrPALa1 : AGTTATGGTGTCACTACNGGGTTCGGCGCTACCTCNACCGCCGAACCAAACAAGGTGGT :540
TrPALa2 : ACNTANGGTGTCNCNACAGGGTTCGGCCCTACCTCGCACCGCCGAACCAAACAAGGTGGT :540
TrPALa3 : AGTTATGGTGTCACTACAGGGTTCGGCGCTACCTCGCACCGCCGAACCAAACAAGGTGGT :530

*       560         *       580         *       600
TrPALa1 : GCTTTGCANAAAGAGCTCATAAGCTAATTTGCTTGTGTCAAT------------------ :582
TrPALa2 : GCTTTGCAGAAAGAGCTCATAAGGTNTTTTGAATGCTGGAATATTTGGAAATGGAACNTG :600
TrPALa3 : GCTTTGCAGAAAGAGCTCATAAGGTNTTTTGAATGCAGGAATATTTGGAAATGGAACNTG :590

*       620
TrPALa1 : -------------------- :  -
TrPALa2 : AGTCNAAGCCACACACTACCC :621
TrPALa3 : ANACAAATCC----------- :600
```

FIGURE 85

```
               *        20         *        40         *        60
TrPALb : GNAGGAAANAATTNTATTGTTATTATTTCCCCCCACACAACGGAAANAATTNTATTGTTN :  60

*        80         *       100         *       120
TrPALb : CTTATTTCCCCCCACACAACATAACNAATACATTNTCCTCTCCTCTCATCACAATTATTA : 120

*       140         *       160         *       180
TrPALb : CTTTCTACACACCCCCCTCTCAACTATTATTAACTAACATAATGGAGGGAATTACCAATG : 180

*       200         *       220         *       240
TrPALb : GCCATGCTGAAGCAACTTTTTGCGTGACCAAAAGTGTTGGTGATCCACTCAACTGGGGTG : 240

*       260         *       280         *       300
TrPALb : CAGCCGCGGAGTCGTTGATGGGGAGTCATTTGGATGAGGTGAAGCGTATGGTGGAGGAAT : 300

*       320         *       340         *       360
TrPALb : ACCGTAATCCATTGGTTAAAATTGGCGGCGAGACGCTTACCATTGCTCAGGTGGCTGGAA : 360

*       380         *       400         *       420
TrPALb : TTGCTTCTCATGATAGTGGTGTGAGGGTGGAGCTGTCTGAGTCCGCCAGGGCCGGCGTTA : 420

*       440         *       460         *       480
TrPALb : AGGCGAGTAGTGATTGGGTGATGGACAGCATGAACAATGGGACTGATAGTTATGGTGTTA : 480

*       500         *       520         *       540
TrPALb : CCACCGGTTTCGGCGCCACCTCTCACCGGAGAACCAAGCAGGGTGGTGCCTTGCAGAAGG : 540

*       560         *       580         *       600
TrPALb : AGCTAATTAGGTTTTTGAATGCTGGAATATTTGGCAATGGTACAGAATCTAACTGTACAC : 600

*       620         *       640         *       660
TrPALb : TACCACACACAGCAACCAGAGCTGCAATGCTTGTGAGAATCAACACTCTTCTTCAAGAGG : 660

*       680         *
TrPALb : AATATTTCTTGAATGGCCTTTGTAAATTTTTGG : 693
```

FIGURE 86

```
            *        20         *        40         *        60
TrPALb : MEGITNGHAEATFCVTKSVGDPLNWGAAAESLMGSHLDEVKRMVEEYRNPLVKIGGETLT :  60

*        80         *       100         *       120
TrPALb : IAQVAGIASHDSGVRVELSESARAGVKASSDWVMDSMNNGTDSYGVTTGFGATSHRRTKQ : 120

*       140         *       160         *
TrPALb : GGALQKELIRFLNAGIFGNGTESNCTLPHTATRAAMLVRINTLLQEEYFLNGLCKFL    : 177
```

FIGURE 87

```
             *        20         *        40         *        60
TrPALb1 : GNAGGAAANAATTNTATTGTTATTATTTCCCCCCACACAACAAAACAAATACNATTATTN : 60
TrPALb2 : ---------------------------------------GAGGAAANAATTNTATTGTTN : 21
TrPALb3 : ---------------------------------------CCTTCAATNATTGNTTTGNCN : 21
TrPALb4 : -----------------------------------------GGAAANAATTATNTTGTTN : 19
TrPALb5 : -----------------------------------------GGAAANAATTATATTGTTC : 19
TrPALb6 : ------------------------------------------GAAANAATTNTNTTGTTN : 18
TrPALb7 : ------------------------------------------GAAANAATTNTNTTGTTC : 18
TrPALb8 : ------------------------------------------------------------ :  -

*        80         *       100         *       120
TrPALb1 : CTCCCCTCTCATCACANATTATTACNTTTCNTACNACNCNNCTNNCCTCTCAACTATTA :120
TrPALb2 : NTTTTTCCTACCCACACAACATAACAAATACATTNTCCTCTCCTCTCATCACAATTATTA : 81
TrPALb3 : CCCCAACACACATANACAAATACNATTCTTGCTNCNCTACTNGCATCACAATTATTA : 81
TrPALb4 : NNTTTTTCCCCCCACACNACATAACNAATACATTNTCTTCTCCTCTNATCACAATTATTA : 79
TrPALb5 : CTTATTTCCNCCCACACAACATAACAAATACATTNTCCTCTCCTCTCATCACAATTATTA : 79
TrPALb6 : ATTATTTCCNCCCACACAACATAACNAATACATTATCTCTCCTCTCATCACAATTATTA : 78
TrPALb7 : CTTATTTCCCCCCACACAACATAACAAATACATTNTCCTCTCCTCTCATCACAATTATTA : 78
TrPALb8 : ------------------ANATANANAATCNATNTTCTCTCCTCTANTAACNATNNTNN : 42

*       140         *       160         *       180
TrPALb1 : CTTCTANGCANAANGCAGCAANTACNATGCCAGCNGNTNAANAAANACCAATG :180
TrPALb2 : CTTTCTACANNCCCCCCTCTCAAGTATTATTAACTAACATAATGGAGGGAATTACCAATG :141
TrPALb3 : CTTTCTANNCACCCCCCTCTCAACTATTATTAACTAACATAATGGAGGGAATTACTNAATG :141
TrPALb4 : CTTTCTACANNCCCCCCTCTCAACTATTATTAACTAACATAATGGAGGGAATTACTNAATG :139
TrPALb5 : CTTTCTACACCCCCCCTCTCAACTATTATTAACTAACATAATGGAGGGAATTACCAATG :139
TrPALb6 : CTTTCTANNCACCCCTCCTCTCAACTATTATTAACTAGCATAATGGAGGGAATTACCAATG :138
TrPALb7 : CTTTCTACACCCCCCCTCTCAACTATTATTAACTAACATAATGGAGGGAATTACCAATG :138
TrPALb8 : CTTTCNNNNCNCCCTCTNAACTATTANTAACTNGCATAATGGAGGGAANTACCAATG :102

*       200         *       220         *       240
TrPALb1 : GCCATGCTGAANCAACTTTTTGCGTGACCAAAAGTGTTGGTGATCCACTCAACTGGGGTG :240
TrPALb2 : GCCATGCTGAAGCAACTTTTTGCGTGACCAAAAGTGTTGGTGATCCACTCAACTGGGGTG :201
TrPALb3 : GCCATGCTGAAGCAACTTTTTGCNTACCAAAAGTGTTGGTGATCCACTCAACTGGGGTG :201
TrPALb4 : GCCATGCTGAAGCAACTTTTTGCGTGACCAAAAGTGTTGGTGATCCACTCAACTGGGGTG :199
TrPALb5 : GCCATGCTGAAGCAACTTTTTGCGTGACCAAAAGTGTTGGTGATCCACTCAACTGGGGTG :199
TrPALb6 : GCCATGCTGAANCAACTTTTTGCGTGACCAAAAGTGTTGGTGATCCACTCAACTGGGGTG :198
TrPALb7 : GCCATGCTGAAGCAACTTTTTGCGTGACCAAAAGTGTTGGTGATCCACTCAACTGGGGTG :198
TrPALb8 : GCCATGCTGAANCAACTTTTTGCGTGACCAAAAGTGTTGGTGATCCACTCAACTGGGGTG :162

*       260         *       280         *       300
TrPALb1 : CAGCCGCGGAGTCGTTGACGGGNAGTCATTTGGATGAGGTGAAGCGTATGGTGCAGGACT :300
TrPALb2 : CAGCCGCGGAGTCGTTGATGGGGAGTCATTTGGATGAGGTGAAGCGTATGGTGGAGGAAT :261
TrPALb3 : CAGCCGCGGAGTCGNTGATGGGGAGTNATTTGGATGAGGTCAANCGTATGGTGGAGGAAT :261
TrPALb4 : CAGCCGCGGAGTCGTTGATGGGGAGTCATTTGGATGAGGTGAAGCGTATGGTGGAGGAAT :259
TrPALb5 : CAGCCGCGGAGTCGTTGATGGGGAGTCATTTGGATGAGGTGAAGCGTATGGTGGAGGAAT :259
TrPALb6 : CAGCCGCGGAGTCGTTGACGGGGAGTCATTTGGATGAGGTGAAGCGTATGGTGGAGGAGT :258
TrPALb7 : CAGCCGCGGAGTCGTTGACGGGGAGTCATTTGGATGAGGTGAAGCGTATGGTGGAGGAAT :258
TrPALb8 : CAGCCGCGGAGTCGTCGGGGAGTCATTTGGATGAGGTGAAGCGTATGGTGGAGGAGT :222

*       320         *       340         *       360
TrPALb1 : ACCGTAATCCGTTGGTTAAAATTGGCGGCGAGACGCTTACCATTGCTCAGGTGGCTGGAA :360
TrPALb2 : ACCGTAATCCATTGGTTAAAATTGGCGGCGAGACGCTTACCATTGCTCAGGTGGCTGGAA :321
TrPALb3 : ACCGTAATCCATTGGTTAAAATTGGCGGCGAGACGCTTACCATTGCTCAGGTGGCTGGAA :321
TrPALb4 : ACCGTAATCCATTGGTTAAAATTGGCGGCGAGACGCTTACCATTGCTCAGGTGGCTGGAA :319
TrPALb5 : ACCGTAATCCATTGGTTAAAATTGGCGGCGAGACGCTTACCATTGCTCAGGTGGCTGGAA :319
TrPALb6 : ACCGTAATCCGTTGGCTAAAATTGGCGGCGAGACGCTTACCATTGCTCAGGTGGCTGGAA :318
TrPALb7 : ACCGTAATCCATTGGTTAAAATTGGCGGCGAGACGCTTACCATTGCTCAGGTGGCTGGAA :318
TrPALb8 : ACCGTAATCCGTTGGTTAAAATTGGCGGCGAGACGCTTACCATTGCTCAGGTGGCTGGAA :282
```

FIGURE 88

```
                    *         380         *         400         *         420
TrPALb1 : TTGCTTCTCATGATAGTGGTGTGAGGGTGGAGCTGTCCGAGTCCGCAAGGGCCGGCGTTA :420
TrPALb2 : TTGCTTCTCATGATAGTGGTGTGAGGGTGGAGCTGTCTGAGTCCGCGAGGGCCGGCCTTA :381
TrPALb3 : TTGCTTCTCATGATAGNGNTGTGAGGGTGGAGCTGTCTGAGTNCGCCAGGGCCGGCGTTA :381
TrPALb4 : TTGCTTCTCATGATAGTGGTGTGAGGGTGGAGCTGTCTGAGTCCGCCAGGGCCGGCGTTA :379
TrPALb5 : TTGCTTCTCATGATAGTGGTGTGAGGGTGGAGCTGTCTGAGTCCGCCAGGGCCGGCGTTA :379
TrPALb6 : TTGCTTCTCATGATAGTGGTGTGAGGGTGGAGCTGNNCGAGTCCGCAAGGGCCGGCGTTA :378
TrPALb7 : TTGCTTCTCATCATAGTGGTGTGACGGTGGAGCTGTCTGAGTCCGCCAGGGCCGGCGTTA :378
TrPALb8 : TTGCTTCTCATGATAGTGGTGTGAGGGTGGAGCTGTCCGAGTCCGCAAGGGCCGGCGTTA :342

*         440         *         460         *         480
TrPALb1 : AGGCGAGTAGTCGATTGGGTGATGGATAGCATGAACAATGGGACTGATAGTTACGGTGTTA :480
TrPALb2 : AGGCGAGTAGTGATTGGGTGATGGACAGCATGAACAATGGGACTGATAGTTATGGTGTTA :441
TrPALb3 : ANGCGAGTAGTGATTGNGTGATGGACAGNATGAACAATGGGACTGATAGTTATGCNGTNA :441
TrPALb4 : AGGCGAGTAGTGATTGGGTGATGGACAGCATGAACAATGGGACTGATAGTTATGGTGTTA :439
TrPALb5 : AGGCGAGTAGTGGTTGGGTGATGGACAGCATGAACAATGGGACTGATAGTTATGGTGTTA :439
TrPALb6 : AGGCGAGTACTGATTGGGTGATGNATAACATGAACAATGGGACTGATNGGTNCGGNGCNA :438
TrPALb7 : AGGCGAGTAGTGCTTGGGTGATGGACAGCATGAACAATGGGACTGATAGTTATGGTGTTA :438
TrPALb8 : AGCCGAGTAGTCGATTGGGTGATGGATAGCATGAACAATGGGACTGATAGTTACGGTGTTA :402

*         500         *         520         *         540
TrPALb1 : CCACCGGTTTCGGCGCCACCTCTCACCGGAGAACCAAGCAGGGTGGTGCCTTGCAGAAGG :540
TrPALb2 : CCACCGGTTTCGGCGCCACCTCTCACCGGAGAACCAAGCAGGGTGGTGCCTTGCAGAAGG :501
TrPALb3 : CCACCGGTTTCGGCGCCACCTCTCACCGGAGAACCAAGCAGGGTGGTGCCTTGCAGAAGG :501
TrPALb4 : CCACCGGTTTCGGCGCCACCTCTCACCGGAGAACCAAGCAGGGTGGTGCCTTGCAGAAGG :499
TrPALb5 : CCACTGGTTTCGGCGCCACCTCTCACCGGAGAACCAAGCAGGGTGGTGCCTTGCAGAAGG :499
TrPALb6 : CNN--------------------------------------------------------- :441
TrPALb7 : CCACTGGTTTCGGCGCCACCTCTCACCGGAGAACCAAGCAGGGTGGTGCCTTGCAGAAGG :498
TrPALb8 : CCACCGGTTTTGGTGCCACCTCTCACCGGAGAACCAAGCAGGGTGGTGCCTTGCAGAAGG :462

*         560         *         580         *         600
TrPALb1 : AGCTAATTAGGTTTTTGAATGCTGGAATATTTGGCAATGGTACAGAATCTAN-------- :592
TrPALb2 : AGCTAATTAGGTTTTTGAATGCTGGAATATTTGGCAATGGTACAGAATCTAACTGTACAC :561
TrPALb3 : AGCTAATTATGTTTTTGAATGCTGGAATATTTGGCAATGGTACAGAATCTAACTGTACAC :561
TrPALb4 : AGCTAATTAGGTTTTTGAATGCTGGAATATTTGGCAATGGTACAGAATCTAACTGTACAC :559
TrPALb5 : AGCTAATTAGGTTTTTGAATGCGGGAATATTTGGCAATGGTACAGAATCTAACTGTACAC :559
TrPALb6 : ------------------------------------------------------------ :  -
TrPALb7 : AGCTAATTAGGTTTTTGAATGCGGGAATATTTGGCAATGGTACAGAATCTAACTGTACAC :558
TrPALb8 : AGCTAATTAGGTTTTTGAATGCTGGAATATTTGGCAATGGTACAGAATCTAACTTTACAC :522

*         620         *         640         *         660
TrPALb1 : ------------------------------------------------------------ :  -
TrPALb2 : TACCACACACAGCAACCAGAGCTGCAATGCTTGTGAGAATCAACACTCTTCTTCAAG--- :618
TrPALb3 : TNCNACACACAGCAACCANAGNTGCATTGCTTNGGTGGANNATCACNCTTCTTCTNNAGG :621
TrPALb4 : TACCACACACGGCAACCAGAGCTGCAATGCT--------------------------- :590
TrPALb5 : TACCACACACAGCAACCAGAGCTGCAATGCTTGTGAGAATCAACACTCTTCTTCAAG--- :616
TrPALb6 : ------------------------------------------------------------ :  -
TrPALb7 : TACCACACC--------------------------------------------------- :567
TrPALb8 : TACCACACAC-------------------------------------------------- :532

*         680         *
TrPALb1 : ----------------------------- :  -
TrPALb2 : ----------------------------- :  -
TrPALb3 : AATATTTCTTGAATGGCCTTTGTAAATTTTTGG :654
TrPALb4 : ----------------------------- :  -
TrPALb5 : ----------------------------- :  -
TrPALb6 : ----------------------------- :  -
TrPALb7 : ----------------------------- :  -
TrPALb8 : ----------------------------- :  -
```

FIGURE 88 (cont)

```
                    *        20         *        40         *        60
TrPALc : AACAAGATCGTTATGCCTTAGAACTTCACCTCAATGGCTTGGTCCTTTGATTGAAGTGAT : 60

*        80         *       100         *       120
TrPALc : AAGATTTTCAACCAAATCAATTGAAAGAGAAATTAACTCGGTCAACGACAACCCTTTGAT : 120

*       140         *       160         *       180
TrPALc : CGATGTTTCAAGGAACAAGGCCATTCATGGTGGTAACTTTCAAGGAACACCTATTGGAGT : 180

*       200         *       220         *       240
TrPALc : TTCAATGGATAACACACGTTTAGCTCTTGCTTCAATTGGTAAACTCATGTTTGCTCAATT : 240

*       260         *       280         *       300
TrPALc : CTCTGAACTTGTTAATGATTTTTACAACAACGGGTTGCCTTCGAATCTTACTGCTAGTAG : 300

*       320         *       340         *       360
TrPALc : GAACCCGAGCTTGGACTATGGTTTCAAGGGATCGGAAATTGCCATGGCTTCGTATTGTTC : 360

*       380         *       400         *       420
TrPALc : CGAGTTACAATATCTTGCTAATCCTGTCACCACCCATGTCCAAAGTGCCGAGCAACACAA : 420

*       440         *       460         *       480
TrPALc : CCAAGATGTTAACTCTTTGGGTTTGATTTCATCTAGAAAAACAAATGAAGCTATTGAGAT : 480

*       500         *       520         *       540
TrPALc : TCTCAAGCTCATGTCTTCCACTTTCTTGATTGCATTATGTCAAGCAATCGACTTAAGGCA : 540

*       560         *
TrPALc : CTTGGAGGAAAATCTCAGGAACACCGTCAAGAACACGGT : 579
```

FIGURE 89

```
              *        20         *        40         *        60
TrPALc : TRSLCLRTSPQWLGPLIEVIRFSTKSIEREINSVNDNPLIDVSRNKAIHGGNFQGTPIGV :  60

*        80         *       100         *       120
TrPALc : SMDNTRLALASIGKLMFAQFSELVNDFYNNGLPSNLTASRNPSLDYGFKGSEIAMASYCS : 120

*       140         *       160         *       180
TrPALc : ELQYLANPVTTHVQSAEQHNQDVNSLGLISSRKTNEAIEILKLMSSTFLIALCQAIDLRH : 180

*
TrPALc : LEENLRNTVKNT : 192
```

FIGURE 90

```
              *         20         *         40         *         60
TrPALd : GGTCAATNCAGCTTNGGAGATCTAGTCCCCCTTTCTTACTNTGCTGGTTTACTAACTGGA :  60

*         80         *        100         *        120
TrPALd : AGACCNAATTCTAAAGCTCATGGGCCTACAGGAGAAGTACTTAATGCAAAAGAAGCTTTT : 120

*        140         *        160         *        180
TrPALd : CAATTGGCTGGAATCAATACCGAGTTCTTTGAATTACAACCAAAAGAAGGTCTTGCACTT : 180

*        200         *        220         *        240
TrPALd : GTTAATGGAACTGCTGTTGGTTCTGGTTTAGCTTCTATTGTTCTTTTTGAGGCTAACATA : 240

*        260         *        280         *        300
TrPALd : TTGGCGGTGTTGTCTGAAGTTCTATCGGCAATTTTCGCTGAAGTTATGCAAGGGAAGCCC : 300

*        320         *        340         *        360
TrPALd : GAATTTACTGATCATTTGACACATAAGTTGAAGCACCACCCTGGTCAAATTGAGGCTGCT : 360

*        380         *        400         *        420
TrPALd : GCTATTATGGAACACATTTTGGATGGGAGTGCTTATGTTAAAGACGCGAAGAAGTTGCAT : 420

*        440         *        460         *        480
TrPALd : GAGATGGACCCTTTACAGAAGCCAAAGCAAGATAGATATGCACTTAGAACTTCACCACAA : 480

*        500         *        520         *        540
TrPALd : TGGCTTGGTCCTTTGATTGAAGTGATTAGATTTTCAACCAAGTCAATTGAGAGAGAGATC : 540

*        560         *        580         *
TrPALd : AACTCTGTCAATGACAACCCTTTGATTGATGTTTCGAGAAACAAGGCTTTG : 591
```

FIGURE 91

```
              *         20         *         40         *         60
TrPALd : GQXSXGDLVPLSYXAGLLTGRXNSKAHGPTGEVLNAKEAFQLAGINTEFFELQPKEGLAL :  60

*         80         *        100         *        120
TrPALd : VNGTAVGSGLASIVLFEANILAVLSEVLSAIFAEVMQGKPEFTDHLTHKLKHHPGQIEAA : 120

*        140         *        160         *        180
TrPALd : AIMEHILDGSAYVKDAKKLHEMDPLQKPKQDRYALRTSPQWLGPLIEVIRFSTKSIEREI : 180

*
TrPALd : NSVNDNPLIDVSRNKAL : 197
```

FIGURE 92

```
              *        20         *        40         *        60
TrPALe : GNNGGAAATTNCAACTCNATTNTTTCTTTNTATAATNTTTGAATTTCCTTCTCTCTCAAA :  60

*        80         *       100         *       120
TrPALe : TTCTATAGCTACTCTACCACATCACACAACATAACAAATTAAGAAATATTCATTACTATA : 120

*       140         *       160         *       180
TrPALe : CTATTAAGATATGGAAGTAGTAGCAGCAGCAATCACAAAAAACAACGGCAAGATTGATTC : 180

*       200         *       220         *       240
TrPALe : ATTTTGCTTGAATCATGCTAATGCTAATAACATGAAAGTGAATGATGCTGATCCTTTGAA : 240

*       260         *       280         *       300
TrPALe : TTGGGGTGTGGCTGCTGAGGCAATGAAGGGAAGTCACTTGGATGAGGTGAAACGTATGGT : 300

*       320         *       340         *       360
TrPALe : GGAGGAGTACCGGAAGCCGATTGTCCGTCTTGGTGGCGAGACGCTGACGATTTCTCAGGT : 360

*       380         *       400         *       420
TrPALe : GGCTGCCATTGCTGCACACGATGGTGCGATGGTTGAGCTGTCGGAATCTGCTAGAGCCGG : 420

*       440         *       460         *       480
TrPALe : CGTTAAGGCAAGCAGTGATTGGGTTATGGAGAGTATGAACAAAGGTACTGACAGTTATGG : 480

*       500         *       520         *       540
TrPALe : TGTCACCACAGGGTTCGGCGCTACCTCNCACCGCCGAACCAAACAAGGTGGTGCTTTACA : 540

*       560         *       580         *
TrPALe : GAAAGGGCTCATAAGGTTTTTGAATGCTGGAATATTTGNAAATGNAACTGAN : 592
```

FIGURE 93

```
              *        20         *        40         *        60
TrPALe : MEVVAAAITKNNGKIDSFCLNHANANNMKVNDADPLNWGVAAEAMKGSHLDEVKRMVEEY :  60

*        80         *       100         *       120
TrPALe : RKPIVRLGGETLTISQVAAIAAHDGAMVELSESARAGVKASSDWVMESMNKGTDSYGVTT : 120

*       140         *
TrPALe : GFGATXHRRTKQGGALQKGLIRFLNAGIFXNXTX : 154
```

FIGURE 94

```
              *        20         *        40         *        60
TrPALf : CNATTGTTAGTNGTTTCCNCCCACCCACATAACAAATACATAATTCTCTCCTCTGATCAC : 60

*        80         *       100         *       120
TrPALf : AATTATTACTTTACTACACCCTCCTCTCAACTATTATTAACTAGCATAATGGAGGGAATT : 120

*        140        *       160         *       180
TrPALf : ACCAATGGCCATGCTGAAACAACTTTTAGCGTGACCAAAAGTGNNGGNGATCCACTCAAC : 180

*        200        *       220         *       240
TrPALf : TGGCGNGCAGCCGCGGAGTCGTCGACGGGGAGTCATTTGGATGAGGTGAAGCGTATGGNG : 240

*        260        *       280         *       300
TrPALf : GAGGAGTACCGTAATCCGNTGGTTAAAATTGGCGGCGAGACGCTTACCATTGCTNNGGTA : 300

*        320        *       340         *       360
TrPALf : NCTGGAATTGCTTCTCATGATAGTGGAGTGAGGGTGGAGCTGTCCGAGTTCGCAAGGGCC : 360

*        380        *       400         *       420
TrPALf : GGCGTTAAGGCGAGTAGTGATTGNGTGATGGATAGCATGAACAATGGGACTGATAGTTAC : 420

*        440        *       460         *       480
TrPALf : GGTGTTACCACCGCNTTTGGTGCCACCTGTCACCGGAGAACCAAGCCANGGTGGTGCCTT : 480

*        500        *       520         *       540
TrPALf : GCAGAAGGAGCTAAATTNNGGTGTTTTGAANGCTGGNAATANTTTGGCNNTGGTTCAGAA : 540

*        560
TrPALf : ATCTNAACTTGTNCACTTACCACACC : 566
```

FIGURE 95

```
                  *        20         *        40         *        60
TrPALf : MEGITNGHAETTFSVTKSXXDPLNWXAAAESSTGSHLDEVKRMXEEYRNPXVKIGGETLT :  60

*        80         *       100         *       120
TrPALf : IAXVXGIASHDSGVRVELSEFARAGVKASSDXVMDSMNNGTDSYGVTTXFGATCHRRTKP  : 120

*       140         *
TrPALf : XWCLAEGAKXXCFEXWXXFGXGSEIXTCXLTT : 152
```

FIGURE 96

```
               *        20         *        40         *        60
TrPALf1 : CNATTGTTAGTNGTTTCCNCCCACCNACATAACNAATACNTANTTCTCTCCTCTGATCAC :  60
TrPALf2 : ----------------------------CCCATAACAAATACATTATTCTCTCCTCTGATCAC :  35

*        80         *       100         *       120
TrPALf1 : AATTATTACTTTNCTACACCCTCCTCTCAACTATTATTAACTAGCATAATGGAGGGAATT :120
TrPALf2 : AATTATTACTTTACTACACCCTCCTCTCAACTATTATTAACTAGCATAATGGAGGGAATT : 95

*       140         *       160         *       180
TrPALf1 : ACCAATGGCCATGCTGAAACAACTTTTTGCGTGACCAAAAGTGTNGGNGATNNANTGNNC :180
TrPALf2 : ACCAATGGCCATGCTGAAACAACTTTTATCGTGACCAAAAGTGNNGGTGATCCACTCAAC :155

*       200         *       220         *       240
TrPALf1 : TGNCGNGN---------------------------------------------------- :188
TrPALf2 : TGGNGTGCAGCCGCGGAGTCGTCGACGGGGAGTCATTTGGATGAGGTGAAGCGTATGGNG :215

*       260         *       280         *       300
TrPALf1 : ------------------------------------------------------------ :  -
TrPALf2 : GAGGAGTACCGTAATCCGNTGGTTAAAATTGGCGGCGAGACGCTTACCATTGCTNNGGTA :275

*       320         *       340         *       360
TrPALf1 : ------------------------------------------------------------ :  -
TrPALf2 : NCTGGAATTGCTTCTCATGATAGTGGAGTGAGGGTGGAGCTGTCCGAGTTCGCAAGGGCC :335

*       380         *       400         *       420
TrPALf1 : ------------------------------------------------------------ :  -
TrPALf2 : GGCGTTAAGGCGAGTAGTGATTGNGTGATGGATAGCATGAACAATGGGACTGATAGTTAC :395

*       440         *       460         *       480
TrPALf1 : ------------------------------------------------------------ :  -
TrPALf2 : GGTGTTACCACCGCNTTTGGTGCCACCTGTCACCGGAGAACCAAGCCANGGTGGTGCCTT :455

*       500         *       520         *       540
TrPALf1 : ------------------------------------------------------------ :  -
TrPALf2 : GCAGAAGGAGCTAAATTNNGGTGTTTTGAANGCTCCNAATANTTTGGCNNTGGTTCAGAA :515

*       560
TrPALf1 : -------------------------  :  -
TrPALf2 : ATCTNAACTTGTNCACTTACCACACC :541
```

FIGURE 97

```
                *        20         *        40         *        60
TrVRa : GTAAGAGTTGAGAAAAAAANACCAATAAAGTAAACNCTATNTAGAAAGAGAGTCAAAAATG :   60
                *        80         *       100         *       120
TrVRa : GCTGAAGGAAAAGGAAGGGTTTGTGTTACTGGAGGAACAGGTTTTCTTGGTTCATGGATC :  120
                *       140         *       160         *       180
TrVRa : ATCAAGAGTCTTCTTGAAAATGGATACTCTGTTAATACCACTATTAGAGCTGATCCAGAA :  180
                *       200         *       220         *       240
TrVRa : CGTAAGAGGGATGTAAGCTTCCTAACAAATCTACCCGGCGCATCCGAAAGGCTACATTTC :  240
                *       260         *       280         *       300
TrVRa : TTCAACGCCGATCTAGACGACCCAGAGAGTTTCAACGAAGCAATTGAAGGTTGTGTCGGG :  300
                *       320         *       340         *       360
TrVRa : ATATTCCACACCGCTTCACCAATCGATTTCGCCGTGAGTGAGCCAGAAGAAATAGTGACA :  360
                *       380         *       400         *       420
TrVRa : AAAAGAACAGTGGATGGAGCATTAGGAATTTTAAAAGCATGTGTGAATTCAAAGACAGTG :  420
                *       440         *       460         *       480
TrVRa : AAGAGATTTATTTACACTTCAAGNGGTTCTGCTGTTTCATTCAATGGAAAAAACAAAGAT :  480
                *       500         *       520         *       540
TrVRa : GNNTNGGATGAGAGTGATTGGAGTGATGTTGATTTGCTTAGAAGTGTTAAACCATTTGGT :  540
                *       560         *       580         *       600
TrVRa : TGGAGTTATGGNGTGTTCAAGACTTTGGCTGAGAAAGCAGTGCTTGAATTTGGTCNACAA :  600
                *       620         *       640         *       660
TrVRa : AATGGGATTGATGTTGTTACTTTGATTCTTCCTTTTATTGTTGGAGGTTTTGTTTGTCCC :  660
                *       680         *       700         *       720
TrVRa : AAGCTTCCTGATTCTGTTGAGAAAGCTCTTGTTTTGGTACTAGGCAAAAAGCAACAAATT :  720
                *       740         *       760         *       780
TrVRa : GGTATTATAAGTTTCCACATGGTACATGTAGATGATGTGGCTAGAGCACATATCTATCTA :  780
                *       800         *       820         *       840
TrVRa : CTTGAGAATCCTGTTCCAGGAGGTAGATATAATTGTTCACCATTCTTTGTATCTATTGAA :  840
                *       860         *       880         *       900
TrVRa : GAAATGTCACAGCTTCTCTCAGCCAAATATCCAGAATATCAAATACTATCAGTAGATGAG :  900
                *       920         *       940         *       960
TrVRa : TTGAAGGAAATTAAAGGGGCAAGATTGCCAGATTTGAACTCGAAGAAGCTCGTGGACGCT :  960
                *       980         *      1000         *      1020
TrVRa : GGTTTTGAGTTTAAGTATAGTGTCGATGATATGTTCGATGATGCGATTCAATGCTGCAAG : 1020
                *      1040         *      1060         *      1080
TrVRa : GAAAAAGGCTATCTCTAAGCATGTATTTGAAAATTCCATGAAGTTGAGAAAACAATAATG : 1080
                *      1100         *      1120         *      1140
TrVRa : TGCCTAAAATCAATGATGGCTAATGAGATGTACAAGTTTATGCATTAAGTTATTTGTGAT : 1140
                *      1160         *      1180
TrVRa : CAATCAAATAATGAAATAATCTGTTCATTTTTCCGAAAAAAAAAA : 1185
```

FIGURE 98

```
                *        20         *        40         *        60
TrVRa : MAEGKGRVCVTGGTGFLGSWIIKSLLENGYSVNTTIRADPERKRDVSFLTNLPGASERLH :  60

*        80         *       100         *       120
TrVRa : FFNADLDDPESFNEAIEGCVGIFHTASPIDFAVSEPEEIVTKRTVDGALGILKACVNSKT : 120

*       140         *       160         *       180
TrVRa : VKRFIYTSXGSAVSFNGKNKDXXDESDWSDVDLLRSVKPFGWSYXVFKTLAEKAVLEFGX : 180

*       200         *       220         *       240
TrVRa : QNGIDVVTLILPFIVGGFVCPKLPDSVEKALVLVLGKKEQIGIISFHMVHVDDVARAHIY : 240

*       260         *       280         *       300
TrVRa : LLENPVPGGRYNCSPFFVSIEEMSQLLSAKYPEYQILSVDELKEIKGARLPDLNSKKLVD : 300

*       320
TrVRa : AGFEFKYSVDDMFDDAIQCCKEKGYL : 326
```

FIGURE 99

```
                  *        20         *        40         *        60
TrVRa1 : GTAGTAGTTGAGAAAAAATACNAATAAAGTAAACNCTATNTAGAAAGAGAGTCAAAAATG :  60
TrVRa2 : ---AGAGTTGAGAAAAAANNCCAATAAAGTAAACNCTATNTAGAAAGAGAGTNNAAAATG :  57
TrVRa3 : ------------------------------------------------------------ :   -
TrVRa4 : ------------------------------------------------------------ :   -
TrVRa5 : ------------------------------------------------------------ :   -
TrVRa6 : ------------------------------------------------------------ :   -

*        80         *       100         *       120
TrVRa1 : GCTGAAGGAAAAGGAAGGGTTTGTGTTACTGGAGGAACAGGTTTTCTTGGTTCATGGATC : 120
TrVRa2 : GCTGAAGGAAAAGGAAGGGTTTGTGTTACTGGAGGAACAGGTTTTCTTGGTTCATGGATC : 117
TrVRa3 : ------------------------------------------------------------ :   -
TrVRa4 : ------------------------------------------------------------ :   -
TrVRa5 : ------------------------------------------------------------ :   -
TrVRa6 : ------------------------------------------------------------ :   -

*       140         *       160         *       180
TrVRa1 : ATCAAGAGTCTTCTTGAAAATGGATACTCTGTTAATACCACTATTAGAGCTGATCCAGAA : 180
TrVRa2 : ATCAAGAGTCTTCTTGAAAATGGATACTCTGTTAATACCACTATTAGAGCTGATCCAGAA : 177
TrVRa3 : ------------------------------------------------------------ :   -
TrVRa4 : ------------------------------------------------------------ :   -
TrVRa5 : ------------------------------------------------------------ :   -
TrVRa6 : ------------------------------------------------------------ :   -

*       200         *       220         *       240
TrVRa1 : CGTAAGAGGGATGTAAGCTTCCTAACAAATCTACCCGGCGCATCCGAAAGGCTACATTTC : 240
TrVRa2 : CGTAAGAGGGATGTAAGCTTCCTAACAAATCTACCCGGCGCATCCGAAAGGCTACATTTC : 237
TrVRa3 : ------------------------------------------------------------ :   -
TrVRa4 : ------------------------------------------------------------ :   -
TrVRa5 : ------------------------------------------------------------ :   -
TrVRa6 : ------------------------------------------------------------ :   -

*       260         *       280         *       300
TrVRa1 : TTCAACGCCGATCTAGACGACCCAGAGAGTTTCAACGAAGCAATTGAAGGTTGTGTCGGG : 300
TrVRa2 : TTCAACGCCGATCTAGACGACCCAGAGAGTTTCAACGAAGCAATTGAAGGTTGTGTCGGG : 297
TrVRa3 : ------------------------------------------------------------ :   -
TrVRa4 : ------------------------------------------------------------ :   -
TrVRa5 : ------------------------------------------------------------ :   -
TrVRa6 : ------------------------------------------------------------ :   -

*       320         *       340         *       360
TrVRa1 : ATATTCCACACCGCTTCACCAATCGATTTCGCCGTGAGTGAGCCAGAAGAAATAGTGACA : 360
TrVRa2 : ATATTCCACACCGCTTCACCAATCGATTTCGCCGTGAGTGAGCCAGAAGAAATAGTGACA : 357
TrVRa3 : ------------------------------------------------------------ :   -
TrVRa4 : ------------------------------------------------------------ :   -
TrVRa5 : ------------------------------------------------------------ :   -
TrVRa6 : ------------------------------------------------------------ :   -

*       380         *       400         *       420
TrVRa1 : AAAAGAACAGTGGATGGAGCATTAGGAATTTTAAAAGCATGTGTGAATTCAAAGACAGTG : 420
TrVRa2 : AAAAGAACAGTGGATCGACCATTAGGAATTTTAAAAGCATGTGTGAATTCAAAGACAGTG : 417
TrVRa3 : ------------------------------------------------------------ :   -
TrVRa4 : ------------------------------------------------------------ :   -
TrVRa5 : ------------------------------------------------------------ :   -
TrVRa6 : ------------------------------------------------------------ :   -
```

FIGURE 100

```
                    *         440         *         460         *         480
TrVRa1 : AAGAGATTTATTTACACTTCAAGNGGTTCTGCTGTTTCATTCAATGNAAAAANCAAAGAT :  480
TrVRa2 : AAGAGATTTATTTACACTTCAAGTGGTTCTGCTGTTTCATTCAATGGAAAAAACAAAGAT :  477
TrVRa3 : ------------------------------------------------------------ :    -
TrVRa4 : ------------------------------------------------------------ :    -
TrVRa5 : ------------------------------------------------------------ :    -
TrVRa6 : ------------------------------------------------------------ :    -

*         500         *         520         *         540
TrVRa1 : CNNTNNNATGANA----------------------------------------------- :  493
TrVRa2 : GTTTTGGATGAGAGTGATTGGAGTGATGTTGATTTGCTTAGAAGTGTTAAACCATTTGGT :  537
TrVRa3 : ------------------------------------------------------------ :    -
TrVRa4 : ------------------------------------------------------------ :    -
TrVRa5 : ------------------------------------------------------------ :    -
TrVRa6 : ------------------------------------------------------------ :    -

*         560         *         580         *         600
TrVRa1 : ------------------------------------------------------------ :    -
TrVRa2 : TCGAGTTATCGTGTNTTCAAGACTTTGGCTGAGAAAGCAGTGCTTGAATTTGGTCNACAA :  597
TrVRa3 : ---------GNGTGTTNAAGACTTTNGCTGAGAAAGCAGTGCTTGAATTTGGTNACAA   :   50
TrVRa4 : ---------------AGACNTTNGCTGAGAAAGCNGTGCTTGAATTTGGTNACAA       :   41
TrVRa5 : ------------------------------NTTGAATTTCCNCNACAA              :   19
TrVRa6 : ------------------------------NTTGAATTTGGTNNACAA              :   19

*         620         *         640         *         660
TrVRa1 : ------------------------------------------------------------ :    -
TrVRa2 : AATG-------------------------------------------------------- :  601
TrVRa3 : AATGGGATTGATGTTGTTACTTTGATTCTTCCTTTTATTGTTGGAGGTTTTGTTTGTCCN :  110
TrVRa4 : AATGGGATTGATGTTGTTACTTTGATTCTTCCTTTTATTGTTGGAGGTTTTGTTTGTCCC :  101
TrVRa5 : AATGGGATTGATGTTGTTACTTTGATTCTTCCTTTTNTTGTTGGAGGTTTTGTTTGTCCC :   79
TrVRa6 : AATGGGATTGATGTTGTTACTTTGATTCTTCCTTTTNTTGTTGGAGGTTTTGTTTGTCCC :   79

*         680         *         700         *         720
TrVRa1 : ------------------------------------------------------------ :    -
TrVRa2 : ------------------------------------------------------------ :    -
TrVRa3 : AAGCTTCCTGATTCTGTTGAGAAAGCTCTTGTTTTGGTACTAGGCAAAAAGGAACAAATT :  170
TrVRa4 : AAGCTTCCTGATTCTGTTGAGAAAGCTCTTGTTTTGGTACTAGGCAAAAAGGAACAAATT :  161
TrVRa5 : AAGCTTCCTGATTCTGTTGAGAAAGCTCTTGTTTTGGTACTAGGCAAAAAGGAACAAATT :  139
TrVRa6 : AAGCTTCCTGATTCTGTTGAGAAAGCTCTTGTTTTGGTACTAGGCAAAAAGGAACAAATT :  139

*         740         *         760         *         780
TrVRa1 : ------------------------------------------------------------ :    -
TrVRa2 : ------------------------------------------------------------ :    -
TrVRa3 : GGTATTATAAGTTTCCACATGGTACATGTGGATGATGTGGCTAGAGCACATATCTATCTA :  230
TrVRa4 : GGTATTATAAGTTTCCACATGGTACATGTGGATGATGTGGCTAGAGCACATATCTATCTA :  221
TrVRa5 : GGTATTATAAGTTTCCACATGGTACATGTAGATGATGTGGCTAGAGCACATATCTATCTA :  199
TrVRa6 : GGTATTATAAGTTTCCACATGGTACATGTAGATGATGTGGCTAGAGCACATATCTATCTA :  199

*         800         *         820         *         840
TrVRa1 : ------------------------------------------------------------ :    -
TrVRa2 : ------------------------------------------------------------ :    -
TrVRa3 : CTTGAGAATCCTGTTCCAGGAGGTAGATATAATTGTTCACCATTCTTTGTATCTATTGAA :  290
TrVRa4 : CTTGAGAATCCTGTTCCAGGAGGTAGATATAATTGTTCACCATTCTTTGTATCTATTGAA :  281
TrVRa5 : CTTGAGAATCCTGTTCCAGGAGGTAGATATAATTGTTCACCATTCTTTGTATCTATTGAA :  259
TrVRa6 : CTTGAGAATCCTGTTCCAGGAGGTAGATATAATTGTTCACCATTCTTTGTATCTATTGAA :  259
```

FIGURE 100 (cont)

```
                      *         860         *         880         *         900
TrVRa1 : ------------------------------------------------------------ :   -
TrVRa2 : ------------------------------------------------------------ :   -
TrVRa3 : GAAATGTCACAGCTTCTTTCAGCCAAATATCCAGAATATCAAATACTATCTGTAGATGAG : 350
TrVRa4 : GAAATGTCACAGCTTCTTTCAGCCAAATATCCAGAATATCAAATACTATCTGTAGATGAG : 341
TrVRa5 : GAAATGTCACAGCTTCTCTCAGCCAAATATCCAGAATATCAAATACTATCAGTAGATCAC : 319
TrVRa6 : GAAATGTCACAGCTTCTCTCAGCCAAATATCCAGAATATCAAATACTATCAGTAGATGAG : 319

*         920         *         940         *         960
TrVRa1 : ------------------------------------------------------------ :   -
TrVRa2 : ------------------------------------------------------------ :   -
TrVRa3 : TTGAAGGAAATTAAAGGGGCAAGGTTGCCAGATTTGAACTCGAAGAAGCTCGTGGACGCT : 410
TrVRa4 : TTGAAGGAAATTAAAGGGGCAAGGTTGCCAGATTTGAACTCGAAGAAGCTCGTGGACGCT : 401
TrVRa5 : TTGAAGGAAATTAAAGGTGCAAGATTGCCAGATTTGAACTCGAAGAAGCTCGTGGACGCT : 379
TrVRa6 : TTGAAGGAAATTAAAGCTGCAAGATTGCCAGATTTGAACTCGAAGAAGCTCGTGGACGCT : 379

*         980         *        1000         *        1020
TrVRa1 : ------------------------------------------------------------ :   -
TrVRa2 : ------------------------------------------------------------ :   -
TrVRa3 : GGTTTTGAGTTTAAGTATAGTGTCGATGATATGTTCGATGATGCGATTCAATGCTGCAAG : 470
TrVRa4 : GGTTTTGAGTTTAAGTATAGTGTCGATGATATGTTCGATGATGCGATTCAATGCTGCAAG : 461
TrVRa5 : GGTTTTGAGTTTAAGTATAGTGTCGATGATATGTTTGATGATGCGATTCAATGCTGCAAG : 439
TrVRa6 : GGTTTTGAGTTTAAGTATAGTGTCGATGATATGTTTGATGATGCGATTCAATGCTGCAAG : 439

*        1040         *        1060         *        1080
TrVRa1 : ------------------------------------------------------------ :   -
TrVRa2 : ------------------------------------------------------------ :   -
TrVRa3 : GAAAAGGCTATCTCTAAGCATGTGTTTGAAAATTCCATGAAGTTGAGAAAACAATAGTG : 530
TrVRa4 : GAAAAGGCTATCTCTAAGCATGTGTTTGAAAATTCCATGAAGTTGAGAAAACAATAGTG : 521
TrVRa5 : GAAAAGGCTATCTCTAAGCATGTATTTGAAAATTCCATGAAGTTGAGAAAACAATAATG : 499
TrVRa6 : GAAAAGGCTATCTCTAAGCATGTATTTGAAAATTCCATGAAGTTGAGAAAACAATAATG : 499

*        1100         *        1120         *        1140
TrVRa1 : ------------------------------------------------------------ :   -
TrVRa2 : ------------------------------------------------------------ :   -
TrVRa3 : TGCCTAAAATCAATGATGGCTAATGAGATGTACAAGTTTATGCATTAAGTTATTTGTGAT : 590
TrVRa4 : TGCCTAAAATCAATGATGGCTAATGAGATGTACAAGTTTATGCATTAAGTTATTTGTGAT : 581
TrVRa5 : TGCCTAAAATCAATGATGGCTAATGAGATGTACAAGTTTATGCATTAAGTTATTTGTGAT : 559
TrVRa6 : TGCCTAAAATCAATGATGGCTAATGAGATGTACAAGTTTATGCATTAAGTTATTTGTGAT : 559

*        1160         *        1180
TrVRa1 : --------------------------------------------- :   -
TrVRa2 : --------------------------------------------- :   -
TrVRa3 : CAATCAAATAATGAAATAATCTG---------------------- : 613
TrVRa4 : CAATCAAATAATGAAATAATC------------------------ : 602
TrVRa5 : CAATCAAATAATGAAN----------------------------- : 575
TrVRa6 : CAATCAAATAATGAAATAATCTGTTCATTTTTCCGAAAAAAAAAA : 604
```

FIGURE 100 (cont)

```
                  *         20         *         40         *         60
LpDFRa : GTSYWTTCGAGTTTGAGAGAATGGCTTCCAGGGCAAGGTGTGTGTTACTGGGGCCTCTGG :  60

*         80         *        100         *        120
LpDFRa : CTTTGTTGCTTCTTGGCTTGTCAAAAGACTACTCGAGTCCGGTTATAATGTTCTAGGGAC : 120

*        140         *        160         *        180
LpDFRa : AGTCAGAGACCCAGGCAATCAGAAGAAGGTAGCACACCTCTGGAACTTAGCAGGGGCCAA : 180

*        200         *        220         *        240
LpDFRa : GGAAAGGTTGGAGCTTGTCAAAGCTGACCTCTTGGAAGAAGGGAGCTTCGATGATGCTGT : 240

*        260         *        280         *        300
LpDFRa : GATGGCCTGTGAGGGTGTCTTCCACACTGCATCACCTATCATCACCAAATCTGATACCAA : 300

*        320         *        340         *        360
LpDFRa : GGAAGAAATGCTTGATTCTGCAATTAACGGCACTCTAAACGTGCTGAGATCGTGCAAGAA : 360

*        380         *        400         *        420
LpDFRa : GAATCCTTTTCTCAAAAGGGTTGTTCTCACGTCATCATCGTCAACCGTGAGGCTGAGGGA : 420

*        440         *        460         *        480
LpDFRa : TGAAGCTGAATTCCCACCCAACGTGTTGCTGGATGAAACATCATGGAGCTCCGTGGAGTT : 480

*        500         *        520         *        540
LpDFRa : CTGTGAAAGTATCCAGGTATGGTATGGTGTCGCGAAGATCCTTGCTGAGAAATCAGCTTG : 540

*        560         *        580         *        600
LpDFRa : GGAGTTCGCCAAGGAGAACAACATCGACCTAGTGGCTGTTCTTCCAACGTTCGTGATTGG : 600

*        620         *        640         *        660
LpDFRa : ACCTAATCTCTCGTCTGAATTAGGACCCACTGTTTTAGATGTCCTTGGCTTATTTAAAGG : 660

*        680         *
LpDFRa : AGAGACAGAGAAGTTCACCATGTTTKGGAAGGATG : 695
```

FIGURE 101

```
              *        20         *        40         *        60
LpDFRa :  VFSSLREWLPGQVCVTGASGFVASWLVKRLLESGYNVLGTVRDPGNQKKVAHLWNLAGAK :  60

*        80         *       100         *       120
LpDFRa :  ERLELVKADLLEEGSFDDAVMACEGVFHTASPIITKSDTKEEMLDSAINGTLNVLRSCKK : 120

*       140         *       160         *       180
LpDFRa :  NPFLKRVVLTSSSSTVRLRDEAEFPPNVLLDETSWSSVEFCESIQVWYGVAKILAEKSAW : 180

*       200         *       220         *
LpDFRa :  EFAKENNIDLVAVLPTFVIGPNLSSELGPTVLDVLGLFKGETEKFTMFGKD : 231
```

FIGURE 102

```
              *        20         *        40         *        60
LpDFRa1 : ---------GTTTGAGAGAATGGCTTCNAGGGCAGGTGTGTGTTACTGGGGCCTCTGGC : 50
LpDFRa2 : ------TCGAGTTTGAGAGAATGGCTTCNAGGGCAGGTGTGTGTTACTGGGGCCTCTGGC : 54
LpDFRa3 : -------------------GTNGGCTTCCAGGGCCGGTGTGTGTTACTGGGGCCTCTGGC : 41
LpDFRa4 : --GCATTCGAGTTTGAGAGAATGGCTTCCAGGGCAGGTGTGTGTTACTGGGGCCTCTGGC : 58
LpDFRa5 : GTCTTTCGAGTTTGAGCAGAATGGCTTCNAGGGCAGGTGTGTGTTACTGGGGCCTCTGGC : 60

*        80         *       100         *       120
LpDFRa1 : TTTGTTGCTTCTTGGCTTGTCAAAAGACTACTCGAGTCCGGTTATAATGTTCTAGGGACA :110
LpDFRa2 : TTTGTTGCTTCTTGGCTTGTCAAAAGACTACTCGAGTCCGGTTATAATGTTCTAGGGACA :114
LpDFRa3 : TTTGTTGCTTCTTGGCTTGTNAAA-GACTACTCGAGTCCGGTTATAATGTTCTAGGGACA :100
LpDFRa4 : TTTGTTGCTTCCTGGCTTGTCAAAAGACTTCTCGAGTCCGGTTATAATGTTCTAGGGACA :118
LpDFRa5 : TTTGTTGCTTCCTGGCTTGTCAAAAGACTTCTCGAGTCCGGTTATAATGTTCTAGGGACA :120

*       140         *       160         *       180
LpDFRa1 : GTCAGAGACCCAGGCAATCAGAAGAAGGTAGCACACCTCTGGAACTTAGCAGGGGCCAAG :170
LpDFRa2 : GTCAGAGACCCAGGCAATCAGAAGAAGGTAGCACACCTCTGGAACTTAGCAGGGGCCAAG :174
LpDFRa3 : GTCAGAGACCCAGGCAATCAGAAGAAGGTAGCACACCTCTGGAACTTAGCAGGGGCCAAG :160
LpDFRa4 : GTCAGAGACCCAGGCAATCAGAAGAAGGTAGCACACCTCTGGAGCTTAGCAGGGGCCAAG :178
LpDFRa5 : GTCAGAGACCCAGGCAATCAGAAGAAGGTAGCACACCTCTGGAGCTTAGCAGGGGCCAAG :180

*       200         *       220         *       240
LpDFRa1 : GAAAGGTTGGAGCTTGTCAAAGCTGACCTCTTGGAAGAAGGGAGCTTCGATGATGCTGTG :230
LpDFRa2 : GAAAGGTTGGAGCTTGTCAAAGCTGACCTCTTGGAAGAAGGGAGCTTCGATGATGCTGTG :234
LpDFRa3 : GAAAGGTTGGAGCTTGTCAAAGCTGACCTCTTGGAAGAAGGGAGCTTCGATGATGCTGTG :220
LpDFRa4 : GAAAGGCTGGAGCTTGTCAGAGCTGACCTCTTGGAAGAAGGGAGCTTCGATGATGCCGTG :238
LpDFRa5 : GAAAGGCTGGAGCTTGTCAGAGCTGACCTCTTGGAAGAAGGGAGCTTCGATGATGCCGTG :240

*       260         *       280         *       300
LpDFRa1 : ATGGCCTGTGAGGGTGTCTTCCACACTGCATCACCTATCATCACCAAATCTGATACCAAG :290
LpDFRa2 : ATGGCCTGTGAGGGTGTCTTCCACACTGCATCACCTATCATCACCAAATCTGATACCAAG :294
LpDFRa3 : ATGGCCTGTGAGGGTGTCTTCCACACTGCATCACCTATCATCACCAAATCTGATACCAAG :280
LpDFRa4 : ATGGCCTGTGAGGGTGTCTTCCACACTGCATCACCTATCATCACCAAATCTGATACCAAG :298
LpDFRa5 : ATGGCCTGTGAGGGTGTCTTCCACACTGCATCACCTATCATCACCAAATCTGATACCAAG :300

*       320         *       340         *       360
LpDFRa1 : GAAGAAATGCTTGATTCTGCAATTAACGGCACTCTAAACGTGCTGAGATCGTGCAAGAAC :350
LpDFRa2 : GAAGAAATGCTTGATTCTGCAATTAACGGCACTCTAAACGTGCTGAGATCGTGCAAGAAG :354
LpDFRa3 : GAAGAAATGCTTGATTCTGCAATTAACGGCACTCTAAACGNGCTGAGATCGNGCAAGAAG :340
LpDFRa4 : GAAGAAATGCTTGATTCTGCAATAAACGGCACTCTAAACGTGCTGAGATCGTGCAAGAAG :358
LpDFRa5 : GAAGAAATGCTTGATTCTGCAATAAACGGCNCTCTAAACGTGCTGNNATCCGGTNAAAA- :360

*       380         *       400         *       420
LpDFRa1 : AATCCTTTTCTCAAAAGGGTTGTTCTCACGTCATCATCGTCAACCGTGAGGCTGAGGGAT :410
LpDFRa2 : AATCCTTTTCTCAAAAGGGTTGTTCTCACGTCATCATCGTCAACCGTGAGGCTGAGGGAT :414
LpDFRa3 : AATNCTTTTCTNAAAAGGGNTGNTCTCACGTCATCATCGCACCCGNGANGCTGANGGAT :400
LpDFRa4 : AATCCTTTTCTCAAAAGGGTTGTTCTCACGTCATCATCGTCAACCGTGAGGCTGAGGGAT :418
LpDFRa5 : AAANN------------------------------------------------------- :365

*       440         *       460         *       480
LpDFRa1 : GAAGCTGAATTCCCACCCAACGTGTTGCTGGATGAAACATCATGGAGCTCCGTGGAGTTC :470
LpDFRa2 : GAAGCTGAATTCCCACCCAACGTGTTGCTGGATGAAACATCATGGAGCTCCGTGGAGTTC :474
LpDFRa3 : GAANCTGANTTCCCACCCAACGNGN----------------------------------- :425
LpDFRa4 : GAAGCTGAATTCCCACCCAACGTGTTGCTGGATGAAACATCATGGAGCTCCGTGGAGTTC :478
LpDFRa5 : ------------------------------------------------------------ :   -
```

FIGURE 103

```
                   *         500         *         520         *         540
LpDFRa1 : TGTGAAAGTATCCAGGTATGGTATGGTGTCGCGAAGATCCTTGCTGAGAAATCAGCTTCG :530
LpDFRa2 : TGTGAAAGTATCCAGGTATGGTATGGTGTCGCGAAGATCCTTGCTGAGAAATCAGCTTGG :534
LpDFRa3 : ------------------------------------------------------------ :  -
LpDFRa4 : TGTGAAAGTATCCAGGTATGGTACGGTGTCGCAAAGATCCTTGCCGAGAAATCAGCCTGG :538
LpDFRa5 : ------------------------------------------------------------ :  -

*         560         *         580         *         600
LpDFRa1 : GAGTTCGCCAAGGAGAACAACATCGACCTAGTGGCTGTTCTTCCAACGTTCGTCATTGGA :590
LpDFRa2 : GAGTTCGCCAAGGAGAACAACATCGACCTAGTGGCTGTTCTTCCAACGTTCGTGATTGGA :594
LpDFRa3 : ------------------------------------------------------------ :  -
LpDFRa4 : GAGTTTGCCAAGGAGAACAACATCGACCTAGTGGCTGTTCTTCCAACATTCGTGATTGGA :598
LpDFRa5 : ------------------------------------------------------------ :  -

*         620         *         640         *         660
LpDFRa1 : CCTAATCTCTCGTCTGAATTAGGACCCACTGTTTTAGATGTCCTTGGCTTATTTAAAGGA :650
LpDFRa2 : CCTAATCTCTCGTCTGAATTAGGACCCACTGTTTTAGATGTCCTTGGCTTATTTAANGGA :654
LpDFRa3 : ------------------------------------------------------------ :  -
LpDFRa4 : CCTAATCTCTCGTCTGAATTAGGACCCACTGTTTTAGATGTCCTTGGCTTATTTAAAGGA :658
LpDFRa5 : ------------------------------------------------------------ :  -

*         680         *
LpDFRa1 : GAGACAGAGAAGTTCAC-------------------- : 667
LpDFRa2 : GAGACAGAGAAGTTCACCATGTTTTGGAAGGATG    : 688
LpDFRa3 : -------------------------------------- :  -
LpDFRa4 : GAGACAGAGAAGTTCACCATGTTTGGGAAGGAN-    : 691
LpDFRa5 : -------------------------------------- :  -
```

FIGURE 103 (cont)

```
              *        20         *        40         *        60
LpDFRb : GTCCTCGCCTACGAGCGCCCCGACGCCCGCGGCCGCTACCTCTGCATCGGGGCCGTGCTG :  60

*        80         *       100         *       120
LpDFRb : CACCGCGCGCACTTCCTAAAGCTTCTCAAGGACCTCTTCCCGCAGTACTCCTTCACCGCC : 120

*       140         *       160         *       180
LpDFRb : AAGTGCGAAGACGACGGCAAGCCCATGGCGAAGCCGTACAAGTTCTCCNACCAGAGGCTC : 180

*       200         *       220         *       240
LpDFRb : AGGGACCTGGGATTAAAATTCACTCCGCTGGCGGAAAGTTTGTACGAGACCGTGACGTGC : 240

*       260         *       280         *       300
LpDFRb : CTGCAAAAAAATGGCCACCTGCCTCTGCCCGCTCCCATGGCGCCAAAGCGTGCATACCTA : 300

*       320         *       340         *       360
LpDFRb : TAATACTACAAAGACACGGCCGGGATCGACAAGCCAAGAAACAGAGGATTCTCCCGAGGT : 360

*       380         *       400         *       420
LpDFRb : TCACCATGGAATTGTGTATTTCACAAAGTTTGAATTCTTATTTTTTTATTATGAAGAAA : 420

*       440         *       460         *       480
LpDFRb : TACGGAAAACCAATACTGTATACCAGAGGCAAGTGTAACAATGTAAATAGTCGTGTAAAT : 480

*       500         *       520
LpDFRb : CTTGTTCAAGAATGAATGATAAAGTATTTTTTGCAAAAAAAAAA : 524
```

FIGURE 104

```
              *        20         *        40         *        60
LpDFRb : VLAYERPDARGRYLCIGAVLHRAHFLKLLKDLFPQYSFTAKCEDDGKPMAKPYKFSXQRL :  60

*        80         *       100
LpDFRb : RDLGLKFTPLAESLYETVTCLQKNGHLPLPAPMAPKRAYL : 100
```

FIGURE 105

```
                    *        20         *        40         *        60
LpDFRb1 : GTCCTCGCCTACGAGCGCCCCGACGCCCGCGGCCGCTACCTCTGCATCGGGGCCGTGCTG : 60
LpDFRb2 : ------------------------------------------------------------ :  -
LpDFRb3 : ------------------------------------------------------------ :  -

*        80         *       100         *       120
LpDFRb1 : CACCGCGCGCACTTCCTAAAGCTTCTCAAGGACCTCTTCCCGCAGTACTCCTTCACCGCC :120
LpDFRb2 : ------------------------------------------------------------ :  -
LpDFRb3 : ------------------------------------------------------------ :  -

*       140         *       160         *       180
LpDFRb1 : AAGTGCGAAGACGACGGCAAGCCCATGGCGAAGCCGTACAAGTTCTCCNACCACAGGCTC :180
LpDFRb2 : ------------------------------AAGCCGTACAAGTTCTCCNACCAGNNGCTC : 30
LpDFRb3 : ---------------------------------GTTCTCNNACCAGAGGCTC : 19

*       200         *       220         *       240
LpDFRb1 : ACGGACCTGGCATTAAAATTCACTCCGCTGGCGGAAAGTTTGTACGAGACCGTGACGTGC :240
LpDFRb2 : AGGGACCTGGGATTAAAATTCACTCCGCTGGCGGAAAGTTTGTACGAGACCGTGACGTGC : 90
LpDFRb3 : AGGGACCTGGGATTAAAATTCACTCCGCTGGCGGAAAGTTTGTACGAGACCGTGACGTGC : 79

*       260         *       280         *       300
LpDFRb1 : CTGCAAAAAAATGGCCACCTGCCTCTGCCCGCTCCCGTGGCGCCAAAGCGTGCATACCTA :300
LpDFRb2 : CTGCAAAAAAATGGCCACCTGCCTCTGCCCGCTCCCATGGCGCCAAAGCGTGCATACCTA :150
LpDFRb3 : CTGCAAAAAAATGGCCACCTGCCTCTGCCCGCTCCCATGGCGCCAAAGCGTGCATACCTA :139

*       320         *       340         *       360
LpDFRb1 : TAATANTACNAAGACACGGCCGGGATCGACAAGCCAAGAAACAGAGGATTCTCCCGAGGT :360
LpDFRb2 : TAATACTACAAAGACACGGCCGGGATCGACAAGCCAAGAAACAGAGGATTCTCCCGAGGT :210
LpDFRb3 : TAATACTACAAAGACACGGCCGGGATCGACAAGCCAAGAAACAGAGGATTCTCCCGAGGT :199

*       380         *       400         *       420
LpDFRb1 : TCACCATGGAATTGTGTATTTCAGAAAGTTTGAATTCTTATTTTTTTTATTATGAAGGAA :420
LpDFRb2 : TCACCATGGAATTGTGTATTTCACAAAGTTTGAATTCTTATTTTTTTTATTATGAAGAAA :270
LpDFRb3 : TCACCATGGAATTGTGTATTTCACAAAGTTTGAATTCTTATTTTTTTTATTATGAAGAAA :259

*       440         *       460         *       480
LpDFRb1 : TACGGATAACCAATACTGTATACCAGAGGCAAGTGTAACAATGTAAATAGTCGTGTAAAT :480
LpDFRb2 : TACGGAAAACCAATACTGTATACCAGAGCCAAGTCTAACAATGTAAATAGTCGTGTAAAT :330
LpDFRb3 : TACGGAAAACCAATACTGTATACCAGAGGCAAGTGTAACAATGTAAATAGTCGTGTAAAT :319

*       500         *       520
LpDFRb1 : CNTGTTCAAGANTGAATGATAAAGTATTTTTTGCAAAANAAAAA :524
LpDFRb2 : CTTGTTCAAGAATGAATGATAAAGTATTTTTTGCAAAAAAAAAA :374
LpDFRb3 : CTTGTTCAAGAATGAATGATAAAGTATTTTTTGCAAAAAAAAN :363
```

FIGURE 106

```
              *        20         *        40         *        60
LpF3Ha : TCTCNAGACACACTGTGTAACCACGGTAGCGAGTGGCAAGACTAGCAGAAAGTACGGACA :   60

*        80         *       100         *       120
LpF3Ha : TCAGCTAACCATTCCTCAACTAGAATAAGCATGGCTCCGGCGATGTCCAACCCTCTCCTC :  120

*       140         *       160         *       180
LpF3Ha : AGTGATCGGGTGGCACGCTCCAAGAAAGTCCCATCTAGCCACGTTAGAGCGGTGGGAGAC :  180

*       200         *       220         *       240
LpF3Ha : CGCCCAGACCTCGCCAATGTCGACCACGAGTCCGGCGCGGGCATTCCGCTCATCGACCTG :  240

*       260         *       280         *       300
LpF3Ha : AAGCAGCTCGAAGGTCCAGGGCGCCGCAGGGTCGTCGAGGCCATCGGCTCCGCGTGCGAG :  300

*       320         *       340         *       360
LpF3Ha : AACGATGGGTTTTTCATGGTGACGAATCATGGCATCCCAGAGGCGGTCGTGGAGGGGATG :  360

*       380         *       400         *       420
LpF3Ha : CTGAGCGTGGCGAGGGAGTTCTTCCACCTGCCGGAGTCGGAGCGGCTCAAGTGCTACTCC :  420

*       440         *       460         *       480
LpF3Ha : GACGACCCCAAGAAGGCGGTCCGGCTGTCGACGAGCTTCAACGTGCGCACGGAGAAGGTG :  480

* .     500         *       520         *       540
LpF3Ha : AGCAACTGGCGCGACTTCCTCCGGCTGCATTGCTACCCTCTTGAGAGCTTCGTCGACCAG :  540

*       560         *       580         *       600
LpF3Ha : TGGCCGTCGAACCCGCCCGCCTTCAGGCAAGTCGTCGGCACCTACTCGACGGAAGCGAGA :  600

*       620         *       640         *       660
LpF3Ha : GCGCTGGCGCTGAGGCTCCTGGAGGCGATATCGGAGAGCCTAGGGCTGGAGAGAGGCCAC :  660

*       680         *       700         *       720
LpF3Ha : ATGGTGAAGGCCATGGGGCGGCACGCGCAGCACATGGCGGTGAACTACTACCCGCCGTGC :  720

*       740         *       760         *       780
LpF3Ha : CCGCAGCCGGAGCTCACCTACGGTCTGCCAGGGCACACGGACCCCAACGCCCTCACCATC :  780

*       800         *       820         *       840
LpF3Ha : CTCCTCATGGATCCCCACGTCTCCGGCCTCCAGGTCCTCAGGGACGGCGCCAAGTGGATC :  840

*       860         *       880         *       900
LpF3Ha : GCCGTCCACCCACGCCCCAACGCCCTGGTCATCAACCTAGGCGACCAGCTACAGGCGCTG :  900

*       920         *       940         *       960
LpF3Ha : AGCAACGGCGCGTACAAGAGCGTGTGGCACCGGGCAGTGGTGAACGCGGAGCAGGAGCGT :  960

*       980         *      1000         *      1020
LpF3Ha : CTGTCGGTGGCATCTTTCCTGTGCCCGTGCAACAGCGCGGTTATCTGCCCCGCGCCGAGG :1020

*      1040         *      1060         *      1080
LpF3Ha : CTCGTCGGCGACGGGGAGGACCCCGTCTACCGGAGCTACACCTACGACGAGTACTACAAG :1080

*      1100         *      1120         *      1140
LpF3Ha : AGGTTTTGGAGCAGGAACCTGGATCAGGAGCACTGCCTCGAGCTCTTCAGGAGTCAGCAC :1140
```

FIGURE 107

```
              *         1160         *         1180         *         1200
LpF3Ha : TGATGCTTGAACCTTGAGTTACTAGCTAGCTCTCCTTAACAGTGCAAATCCATGGCCCAA :1200

*         1220         *         1240         *         1260
LpF3Ha : GAGGGCCCCGATTGCATGGTTACTTATGTTGTTTGAACTGGTATTGCTTAAGTGCCTAAT :1260

*         1280         *         1300         *         1320
LpF3Ha : AACATTGCTACATTCTACTNCTATCTTGTCCGTTTAAAATTATAAGATGGCCTAACCTTT :1320

*         1340         *         1360         *         1380
LpF3Ha : TTCTTAATTGTATGCATNCTGAACATATTTAAGTGTGTGTGTTCAGACAGTTTAGTCTGC :1380

LpF3Ha : A :1381
```

FIGURE 107 (cont)

```
              *        20         *        40         *        60
LpF3Ha : MSNPLLSDRVARSKKVPSSHVRAVGDRPDLANVDHESGAGIPLIDLKQLEGPGRRRVVEA :  60

*        80         *       100         *       120
LpF3Ha : IGSACENDGFFMVTNHGIPEAVVEGMLSVAREFFHLPESERLKCYSDDPKKAVRLSTSFN : 120

*       140         *       160         *       180
LpF3Ha : VRTEKVSNWRDFLRLHCYPLESFVDQWPSNPPAFRQVVGTYSTEARALALRLLEAISESL : 180

*       200         *       220         *       240
LpF3Ha : GLERGHMVKAMGRHAQHMAVNYYPPCPQPELTYGLPGHTDPNALTILLMDPHVSGLQVLR : 240

*       260         *       280         *       300
LpF3Ha : DGAKWIAVHPRPNALVINLGDQLQALSNGAYKSVWHRAVVNAEQERLSVASFLCPCNSAV : 300

*       320         *       340
LpF3Ha : ICPAPRLVGDGEDPVYRSYTYDEYYKRFWSRNLDQEHCLELFRSQH : 346
```

FIGURE 108

```
                     *        20         *        40         *        60
LpF3Ha1 : TCTCNAGACACACTGTGTAACCACGGTAGCGAGTGGCAAGACTAGCAGAAAGTACGGACA :  60
LpF3Ha2 : --TCTAGACACACTGTGTAACCNCGGTAGCGAGTGGCAAGACTAGCAGAAAGTACGGACA :  58
LpF3Ha3 : ------------------------------------------------------------ :   -

*        80         *       100         *       120
LpF3Ha1 : TCAGCTAACCATTCCTCAACTAGAATAAGCATGGCTCCGGCGATGTCCAACCCTCTCCTC : 120
LpF3Ha2 : TCAGCTAACCATTCCTCAACTAGAATAAGCATGGCTCCGGCGATGTCCAACCCTCTCCTC : 118
LpF3Ha3 : ------------------------------------------------------------ :   -

*       140         *       160         *       180
LpF3Ha1 : AGTGATCGGGTGGCACGCTCCAAGAAAGTCCCATCTAGCCACGTTAGAGCGGTGGGAGAC : 180
LpF3Ha2 : AGTGATCGGGTGGCACGCTCCAAGAAAGTCCCATCTAGCCACGTTAGAGCGGTGGGAGAC : 178
LpF3Ha3 : ------------------------------------------------------------ :   -

*       200         *       220         *       240
LpF3Ha1 : CGCCCAGACCTCGCCAATGTCGACCACGAGTCCGGCGCGGGCATTCCGCTCATCGACCTG : 240
LpF3Ha2 : CGCCCAGACCTCGCCAATGTCGACCACGAGTCCGGCGCGGGCATTCCGCTCATCGACCTG : 238
LpF3Ha3 : ------------------------------------------------------------ :   -

*       260         *       280         *       300
LpF3Ha1 : AAGCAGCTCGAAGGTCCAGGGCGCCGCAGGGTCGTCGAGGCCATCGGCTCCGCGTGCGAG : 300
LpF3Ha2 : AAGCAGCTCGAACGTCCAGGGCGCCGCAGGGTCGTCGAGGCCATCGGCTCCGCGTGCCAC : 298
LpF3Ha3 : ------------------------------------------------------------ :   -

*       320         *       340         *       360
LpF3Ha1 : AACGATGGGTTTTTCATGGTGACGAATCATGGCATCCCAGAGGCGGTCGTGGAGGGGATG : 360
LpF3Ha2 : AACGATCGGTTTTTCATGGTGACGAATCATGGCATCCCAGAGGCGGTCGTGGAGGGGATC : 358
LpF3Ha3 : ------------------------------------------------------------ :   -

*       380         *       400         *       420
LpF3Ha1 : CTGAGCGTGGCGAGGGAGTTCTTCCACCTGCCGGAGTCGGAGCGGCTCAAGTGCTACTCC : 420
LpF3Ha2 : CTGAGCGTGGCGAGGGAGTTCTTCCACCTGCCGGAGTCGGAGCGGCTCAAGTGCTACTCC : 418
LpF3Ha3 : ------------------------------------------------------------ :   -

*       440         *       460         *       480
LpF3Ha1 : GACGACCCCAAGAAGGCGGTCCGGCTGTCGACGAGCTTCAACGTGCGCACGGAGAAGGTG : 480
LpF3Ha2 : GACGACCCCAAGAAGGCGGTCCGGCTGTCGACGAGCTTCAACGTGCGCACGGAGAAGGTG : 478
LpF3Ha3 : ------------------------------------------------------------ :   -

*       500         *       520         *       540
LpF3Ha1 : AGCAACTGGCGCGACTTCCTCCGGCTGCATTGCTACCCTCTTGAGAGCTTCGTCGACCAG : 540
LpF3Ha2 : AGCAACTGGCGCGACTTCCTCCGGCTGCATTGCTACCCTCTTGAGAGCTTCGTCGACCAG : 538
LpF3Ha3 : ------------------------------------------------------------ :   -

*       560         *       580         *       600
LpF3Ha1 : TGGCCGTCGAACCCGCCCGCCTTCAGGCAAGTCGTCGGCACCTACTCGACGGAAGCGAGA : 600
LpF3Ha2 : TGGCCGTCGAACCCGCCCGCCTTCAGGCAAGTCGTCGGCACCTACTCGACGGAAGCGAGA : 598
LpF3Ha3 : ------------------------------------------GGGAAGTCCGG        :  12

*       620         *       640         *       660
LpF3Ha1 : GCGCTGGCGCTGAGGCTCCTGGAGGCGATATCGGAGAGCCTAGGGCTGGAGAGAGGCCAC : 660
LpF3Ha2 : GCGCTGGCGCTGAGGCTCCTGGAGGCGATATCGGAGAGCCTAGGGCTGGAGAGAGGCCAC : 658
LpF3Ha3 : CTGCTGGGGCTTCGCTTCTGGCCGCGATCTCGTTGGGCTGGGGCTGGAGNGAGGGTAT   :  72

*       680         *       700         *       720
LpF3Ha1 : ATGGTGAAGGCCATGGGGCGGCACGCGCAGCACATGGCGGTGAACTACTACCCGCCGTGC : 720
LpF3Ha2 : ATGGTGAAGGCCATGGGGCGGCACGCGCAGCACATGGCGGTGAACTACTACCCGCCGTGC : 718
LpF3Ha3 : GTGCAGAACGTGCTGGGCGAGCAGGAGCAGCACATGGCCGTGAACTACTACCCGCCGTGC : 132
```

FIGURE 109

```
              *        740         *        760         *        780
LpF3Ha1 : CCGCAGCCGGAGCTCACCTACGGTCTGCCAGGGCA------------------------ : 755
LpF3Ha2 : CCGCAGCCGGAGCTCACCTACGGTCTGCCAGGGCACACGGACCCCAATGCCCTCACCATN : 778
LpF3Ha3 : CCCGAGCCGGACCTCACCTACGGCCTGCCCAAGCACACGGACCCCAACGCCCTCACCATC : 192

*        800         *        820         *        840
LpF3Ha1 : ------------------------------------------------------------ :   -
LpF3Ha2 : CT---------------------------------------------------------- : 780
LpF3Ha3 : CTCCTCATGGATCCCCACGTCTCCGGCCTCCAGGTCCTCAGGGACGGCGCCAAGTGGATC : 252

*        860         *        880         *        900
LpF3Ha1 : ------------------------------------------------------------ :   -
LpF3Ha2 : ------------------------------------------------------------ :   -
LpF3Ha3 : GCCGTCCACCCACGCCCCAACGCCCTGGTCATCAACCTAGGCGACCAGCTACAGGCGCTG : 312

*        920         *        940         *        960
LpF3Ha1 : ------------------------------------------------------------ :   -
LpF3Ha2 : ------------------------------------------------------------ :   -
LpF3Ha3 : AGCAACGGCGCGTACAAGAGCGTGTGGCACCGGGCAGTGGTGAACGCGGAGCAGGAGCGT : 372

*        980         *       1000         *       1020
LpF3Ha1 : ------------------------------------------------------------ :   -
LpF3Ha2 : ------------------------------------------------------------ :   -
LpF3Ha3 : CTGTCGGTGGCATCTTTCCTGTGCCCGTGCAACAGCGCGGTTATCTGCCCCGCGCCGAGG : 432

*       1040         *       1060         *       1080
LpF3Ha1 : ------------------------------------------------------------ :   -
LpF3Ha2 : ------------------------------------------------------------ :   -
LpF3Ha3 : CTCGTCGGCGACGGGGAGGACCCCGTCTACCGGAGCTACACCTACGACGAGTACTACAAG : 492

*       1100         *       1120         *       1140
LpF3Ha1 : ------------------------------------------------------------ :   -
LpF3Ha2 : ------------------------------------------------------------ :   -
LpF3Ha3 : AGGTTTTGGAGCAGGAACCTGGATCAGGAGCACTGCCTCGAGCTCTTCAGGAGTCAGCAC : 552

*       1160         *       1180         *       1200
LpF3Ha1 : ------------------------------------------------------------ :   -
LpF3Ha2 : ------------------------------------------------------------ :   -
LpF3Ha3 : TGATGCTTGAACCTTGAGTTACTAGCTAGCTCTCCTTAACAGTGCAAATCCATGGCCCAA : 612

*       1220         *       1240         *       1260
LpF3Ha1 : ------------------------------------------------------------ :   -
LpF3Ha2 : ------------------------------------------------------------ :   -
LpF3Ha3 : GAGGGCCCCGATTGCATGGTTACTTATGTTGTTTGAACTGGTATTGCTTAAGTGCCTAAT : 672

*       1280         *       1300         *       1320
LpF3Ha1 : ------------------------------------------------------------ :   -
LpF3Ha2 : ------------------------------------------------------------ :   -
LpF3Ha3 : AACATTGCTACATTCTACTNCTATCTTGTCCGTTTAAAATTATAAGATGGCCTAACCTTT : 732

*       1340         *       1360         *       1380
LpF3Ha1 : ------------------------------------------------------------ :   -
LpF3Ha2 : ------------------------------------------------------------ :   -
LpF3Ha3 : TTCTTAATTGTATGCATNCTGAACATATTTAAGTGTGTGTGTTCAGACAGTTTAGTCTGC : 792

LpF3Ha1 : - :   -
LpF3Ha2 : - :   -
LpF3Ha3 : A : 793
```

FIGURE 109 (cont)

```
   1 GAATTCGATT AAGCAGTGGT AACAACGCAG AGTACGCGGG GACTCTCAGA
  51 ACACACTGTG TAACCACGGT AGCGAGTGGC AAGACTAGCA GAAAGTACGG
 101 ACATCAGCTA ACCATTCCTC AACTAGAATA AGCATGGCTC CGGCGATGTC
 151 CAACCCTCTC CTCAGTGATC GGGTGGCACG CTCCAAGAAA GTCCCATCTA
 201 GCCACGTTAG AGCGGTGGGA GACCGCCCAG ACCTCGCCAA TGTCGACCAC
 251 GAGTCCGGCG CGGGCATTCC GCTCATCGAC CTGAAGCAGC TCGAAGGTCC
 301 AGGGCGCCGC AGGGTCGTCG AGGCCATCGG CTCCGCGTGC GAGAACGATG
 351 GGTTTTTCAT GGTGACGAAT CATGGCATCC CAGAGGCGGT CGTGGAGGGG
 401 ATGCTGAGCG TGGCGAGGGA GTTCTTCCAC CTGCCGGAGT CGGAGCGGCT
 451 CAAGTGCTAC TCCGACGACC CCAAGAAGGC GGTCCGGCTG TCGACGAGCT
 501 TCAACGTGCG CACGGAGAAG GTGAGCAACT GGCGCGACTT CCTCCGGCTG
 551 CATTGCTACC CTCTTGAGAG CTTCGTCGAC CAGTGGCCGT CGAACCCGCC
 601 CGCCTTCAGG CAAGTCGTCG GCACCTACTC GACGGAAGCG AGAGCGCTGG
 651 CGCTGAGGCT CCTGGAGGCG ATATCGGAGA GCCTAGGGCT GGAGAGAGGC
 701 CACATGGTGA AGGCCATGGG GCGGCACGCG CAGCACATGG CGGTGAACTA
 751 CTACCCGCCG TGCCCGCAGC CGGAGCTCAC CTACGGTCTG CCAGGGCACA
 801 AGGACCCCAA TGCCATCACG CTCCTCCTGC AGGACGGCGT CTCCGGCCTG
 851 CAGGTCCAGC GCGACGGCCG GTGGGTGGCC GTCAACCCGG TGCCCAACGC
 901 CCTCGTCATC AACATCGGCG ATCAGTTACA GGCGCTGAGC AACGACCGAT
 951 ACAAGAGCGT GAACCACAGA GTGATCGTCA ACAGCGCGAG CGAGAGGATT
1001 TCGGTGCCGA CGTTCTACTG CCCGTCGCCG GACACGGTGG TCGCGCCGGC
1051 CGACGCGCTG GTGGACGACG CCCACCCTCG GGCCTACCAG CCCTTCACGT
1101 ACCAGGAGTA CTACGAGGAG TTCTGGAAGA TGGGCCTTCA GTCAGCAAGT
1151 TGCCTCGACA GGTTCCGACG GATCGAGTGA TGGACAAGAC GTGGGCCGTT
1201 GTTATCTCCT GGGCCATGAG CGTTGCCGCA GCCGATGTGT CGCCATATGG
1251 TGGAGACGTT TCCTCCCTCC GGAAAAGAAA AATAAAACAG AGTGGAGACC
1301 ACTAGAACCG TCAGATAGCA TCCCAAAAAA AAAAAAAAAA AAAAAAAAA
1351 AAAAGTACTC TGCGTTGTTA CCACTGCTTA ATCACTAGTG AATTC
```

FIGURE 111

```
  1 MAPAMSNPLL SDRVARSKKV PSSHVRAVGD RPDLANVDHE SGAGIPLIDL
 51 KQLEGPGRRR VVEAIGSACE NDGFFMVTNH GIPEAVVEGM LSVAREFFHL
101 PESERLKCYS DDPKKAVRLS TSFNVRTEKV SNWRDFLRLH CYPLESFVDQ
151 WPSNPPAFRQ VVGTYSTEAR ALALRLLEAI SESLGLERGH MVKAMGRHAQ
201 HMAVNYYPPC PQPELTYGLP GHKDPNAITL LLQDGVSGLQ VQRDGRWVAV
251 NPVPNALVIN IGDQLQALSN DRYKSVNHRV IVNSASERIS VPTFYCPSPD
301 TVVAPADALV DDAHPRAYQP FTYQEYYEEF WKMGLQSASC LDRFRRIE
```

FIGURE 112

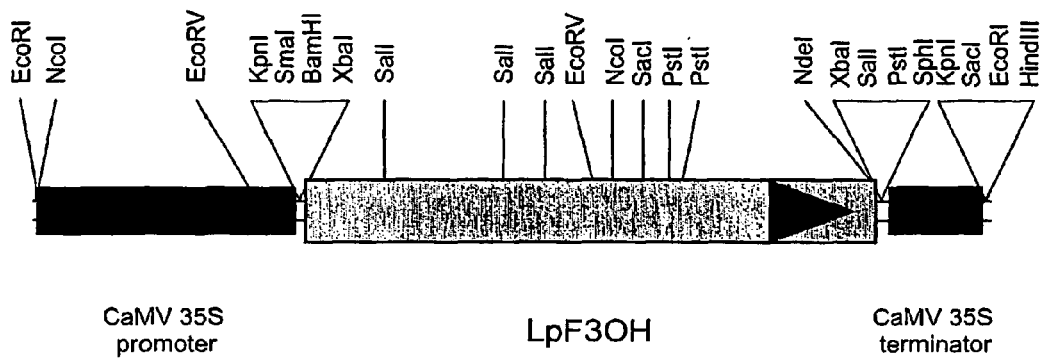
pDH51LpF3OH sense
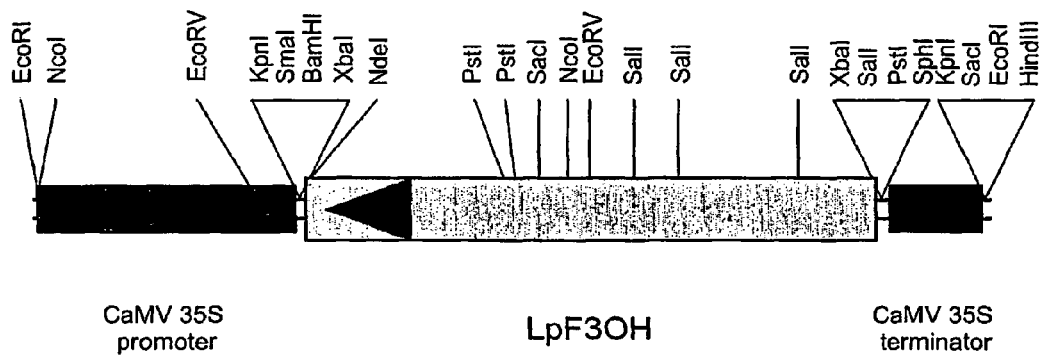
pDH51LpF3OH anti
FIGURE 113

```
   1 GAATTCGATT AAGCAGTGGT AACAACGCAG AGTACGCGGG ATAAAAACTG
  51 CACTAGTGTG TATAAGTTTC TTGGTGAAAA AAGAGTTTGT AAATTAACAT
 101 CATGGCTAGT ATCAAACAAA TTGGAAACAA GAAAGCATGT GTGATTGGTG
 151 GCACTGGTTT TGTTGCATCT ATGTTGATCA AGCAGTTACT TGAAAAGGGT
 201 TATGCTGTTA ATACTACCGT TAGAGACCCA GATAGCCCTA AGAAAATATC
 251 TCACCTAGTG GCACTGCAAA GTTTGGGGGA ACTGAATCTA TTTAGAGCAG
 301 ACTTAACAGT TGAAGAAGAT TTTGATGCTC CTATAGCAGG ATGTGAACTT
 351 GTTTTTCAAC TTGCTACACC TGTGAACTTT GCTTCTCAAG ATCCTGAGAA
 401 TGACATGATA AAGCCAGCAA TCAAAGGTGT GTTGAATGTG TTGAAAGCAA
 451 TTGCAAGAGC AAAAGAAGTT AAAAGAGTTA TCTTAACATC TTCGGCAGCC
 501 GCGGTGACTA TAAATGAACT CAAAGGGACA GGTCATGTTA TGGATGAAAC
 551 CAACTGGTCT GATGTTGAAT TTCTCAACAC TGCAAAACCA CCCACTTGGG
 601 GTTATCCTGC CTCAAAAATG CTAGCTGAAA AGGCTGCATG GAAATTTGCT
 651 GAAGAAAATG ACATTGATCT AATCACTGTG ATACCTAGTT TAACAACTGG
 701 TCCTTCTCTC ACACCAGATA TCCCATCTAG TGTTGGCTTG GCAATGTCTC
 751 TAATAACAGG CAATGATTTT CTCATAAATG CTTTGAAAGG AATGCAGTTT
 801 CTGTCGGGTT CGTTATCCAT CACTCATGTT GAGGATATTT GCCGAGCTCA
 851 TATATTTCTT GCAGAGAAAG AATCAGCTTC TGGTAGATAC ATTTGCTGTG
 901 CTCACAATAC TAGTGTTCCC GAGCTTGCAA AGTTTCTCAA CAAACGATAT
 951 CCTCAGTATA AAGTTCCAAC TGAATTTGAT GATTGCCCCA GCAAGGCAAA
1001 GTTGATAATC TCTTCTGAAA AGCTTATCAA AGAAGGGTTC AGTTTCAAGC
1051 ATGGTATTGC CGAAACTTTC GACCAGACTG TCGAGTATTT TAAGACTAAG
1101 GGGGCACTGA AGAATTAGAT TTTGATATTT CTAATTCAAT AGCAAACTCT
1151 AAGCTTGTTA TGTGTTTGTG AAGTTCAGAG TGAAATATCA AATGAATAAG
1201 TGGAGAGAGC ACAATAAGAG GAGAGCACAA TAATTTTGGA AAAAAAAAA
1251 AAAAAAAAAA AAAAAAAAGT ACTCTGCGTT GTTACCACTG CTTAATCACT
1301 AGTGAATTC
```

FIGURE 117

```
  1  MASIKQIGNK KACVIGGTGF VASMLIKQLL EKGYAVNTTV RDPDSPKKIS
 51  HLVALQSLGE LNLFRADLTV EEDFDAPIAG CELVFQLATP VNFASQDPEN
101  DMIKPAIKGV LNVLKAIARA KEVKRVILTS SAAAVTINEL KGTGHVMDET
151  NWSDVEFLNT AKPPTWGYPA SKMLAEKAAW KFAEENDIDL ITVIPSLTTG
201  PSLTPDIPSS VGLAMSLITG NDFLINALKG MQFLSGSLSI THVEDICRAH
251  IFLAEKESAS GRYICCAHNT SVPELAKFLN KRYPQYKVPT EFDDCPSKAK
301  LIISSEKLIK EGFSFKHGIA ETFDQTVEYF KTKGALKN
```

FIGURE 118

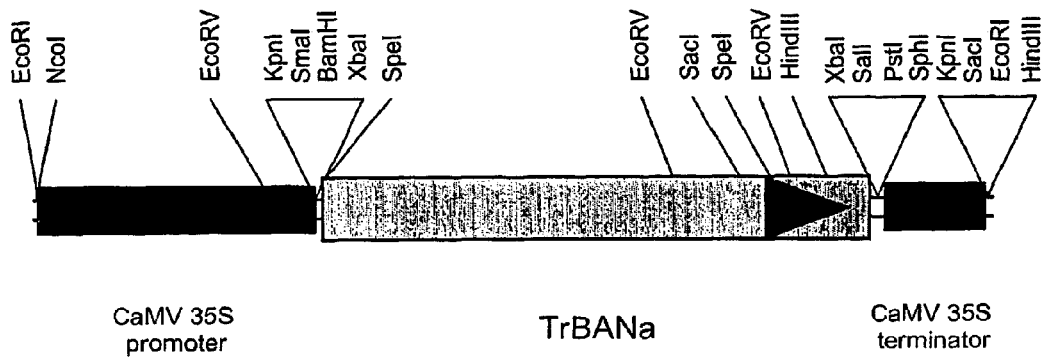
pDH51TrBANa sense
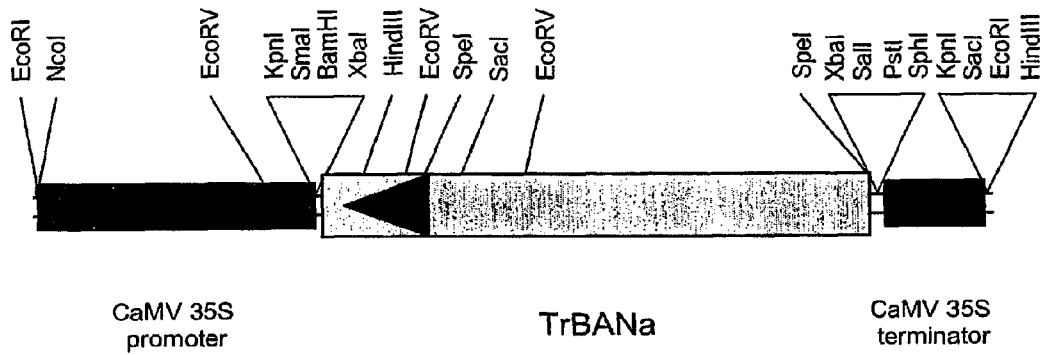
pDH51TrBANa anti
FIGURE 119

```
  1 GAATTCGATT AAGCAGTGGT AACAACGCAG AGTACGCGGG GACTTAAACA
 51 TTGACACAAG TCCCAAATAA AAAAGATCTG AAACAACATA GTCACCCCAT
101 TTTTTAACAT TAAACTAAAA ATATGTCGGC CATCACCGCA ATCCAAGTCG
151 AGAACCTTGA ATTTCCGGCT GTGGTTACTT CTCCGGCCAC CGGTAAGTCA
201 TATTTTCTTG GTGGTGCAGG GGAGAGAGGT TTGACTATTG AAGGAAACTT
251 CATCAAGTTC ACTGCCATAG GAGTATATTT GGAAGATGTA GCAGTGGCTT
301 CACTTGCCAC TAAATGGAAG GGTAAATCCT CTGAGGAGTT GCTTGAGACT
351 CTTGACTTCT ATAGAGACAT CATTTCAGGA CCCTTTGAAA AGTTGATTCG
401 AGGATCGAAG ATTAGGGAAT TGAGTGGTCC TGAGTACTCA AGGAAGGTTA
451 ATGAAAACTG CGTGGCACAC TTAAAATCTG TTGGGACTTA TGGAGATGCT
501 GAAGCTGAAG CTATGCAAAA ATTTGTTGAA GCCTTCAAGC CTATTAATTT
551 TCCACCTGGT GCCTCTGTTT TTTACAGGCA ATCACCTGAT GGAATATTAG
601 GGCTTAGTTT CTCTCAAGAT GCAAGTATAC CAGAAAAGGA GGCTGCAGTA
651 ATAGAGAACA AGGCAGCTTC ATCGGCAGTG TTAGAAACTA TGATTGGTGA
701 ACATGCTGTT TCTCCTGATT TAAAGCGTTG TTTGGCTGCA AGATTACCTG
751 CCTTGTTGAA CGAGGGTACT TTCAAGATTG AATGAAAACT GATTATTATT
801 ATCTCCAAAA GCATTGCAGC ACAAGATTGA GTCATTTATG AGCATGGACA
851 TTTTTATGTC CACACATGTT TAACTTTTGT ATCTCTCTTT AGATTCTCAT
901 CAATATCAAT AATACTAATA TGAAACGAAG TCAAAAAAAA AAAAAAAAAA
951 AAAAAAAAAA AAAAGTACTC TGCGTTGTTA CCACTGCTTA ATCACTAGTG
1001 AATTC
```

FIGURE 122

```
  1 MSAITAIQVE NLEFPAVVTS PATGKSYFLG GAGERGLTIE GNFIKFTAIG
 51 VYLEDVAVAS LATKWKGKSS EELLETLDFY RDIISGPFEK LIRGSKIREL
101 SGPEYSRKVN ENCVAHLKSV GTYGDAEAEA MQKFVEAFKP INFPPGASVF
151 YRQSPDGILG LSFSQDASIP EKEAAVIENK AASSAVLETM IGEHAVSPDL
201 KRCLAARLPA LLNEGTFKIE
```

FIGURE 123

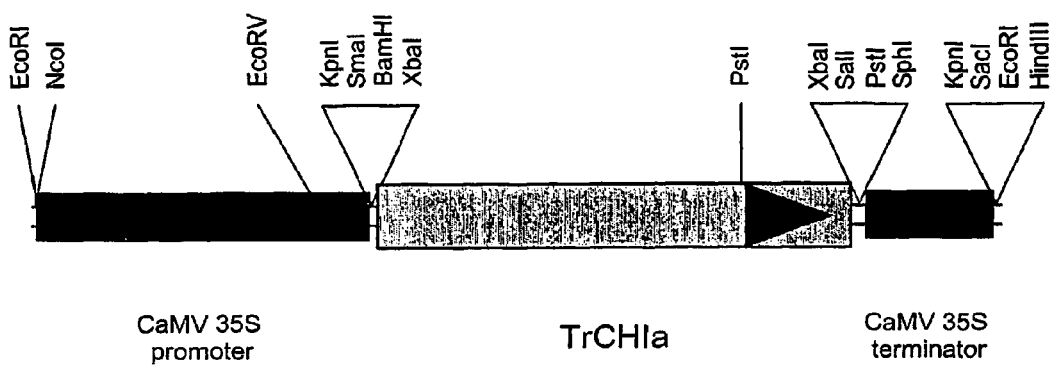
pDH51TrCHIa sense
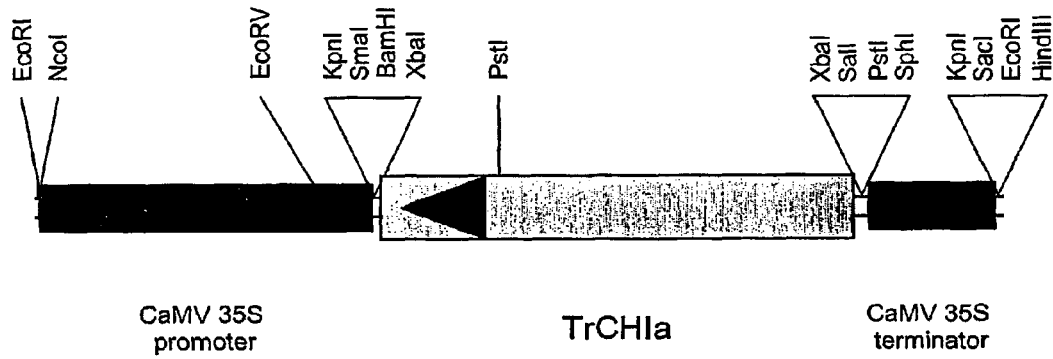
pDH51TrCHIa anti
FIGURE 124

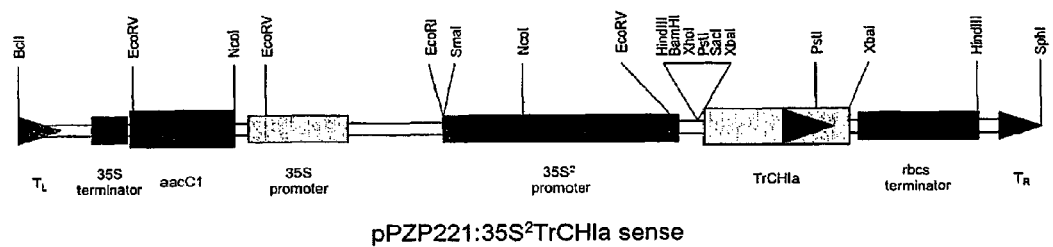
pPZP221:35S²TrCHIa sense
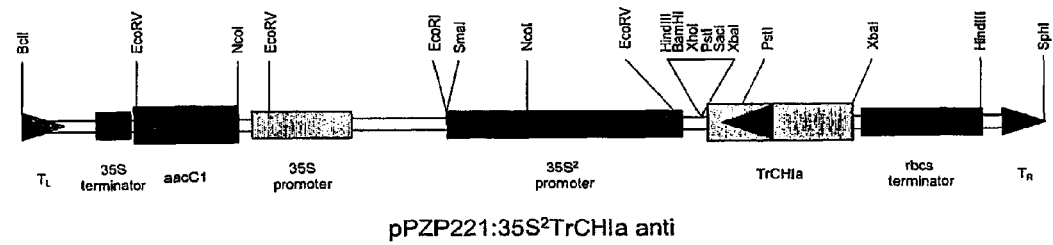
pPZP221:35S²TrCHIa anti
FIGURE 125

```
   1 GAATTCACTA GTGATTAAGC AGTGGTAACA ACGCAGAGTA CGCGGGGACA
  51 TTACAACTCA CAACACCTTC TCCATTACCA TCTATCTTCT ACTAAGTTCA
 101 ACGAGATCAA TGGCACTTCC TTCTGTCACC GCTTTGAATA TCGAGAACAA
 151 TCTATTCCCT CCTACCGTCA CACCACCGGG ATCCACCAAC AATTTCTTCC
 201 TCGGCGGTGC AGGAGAGCGG GGTCTTCAAA TTCAAGACAA ATTTGTCAAA
 251 TTCACCGCTA TTGGTGTTTA TCTACAGGAC ATTGCTGTTC CTTACCTCGC
 301 CACTAAATGG AAGGGTAAGA CTGCTCAAGA GCTAACGGAA ACTGTTCCTT
 351 TCTTCAGGGA CATCGTTACA GGTCCATTTG AGAAATTTAT GCAGGTGACA
 401 ATGATCTTGC CATTGACTGG GCAACAATAC TCAGAGAAAG TGTCAGAAAA
 451 TTGTGTAGCT ATTTGGAAGT CTCTTGGGAT TTATACCGAC GAAGAAGCCA
 501 AAGCAATTGA GAAGTTTGTT TCTGTCTTCA AAGATGAAAC ATTCCCACCA
 551 GGCTCCTCTA TCCTTTTCAC AGTATTACCC AAAGGATTAG GATCACTAAC
 601 GATAAGTTTC TCTAAAGATG GATCCATTCC AGAGACCGAG TCTGCAGTTA
 651 TAGAGAATAA GCTACTCTCA CAAGCTGTGC TTGAGTCGAT GATAGGGGCG
 701 CACGGTGTCT CCCCTGCAGC AAAACAGAGT TTGGCCACCA GGTTATCCGA
 751 GTTATTCAAC GAGGTTGGTG ATGCTAGCAA CTGATTATAT CAACAAAACG
 801 AAAATGAAAG TCCTTTCTGC AATAAAGACC AAGCGGAAAT TTTATTTTAG
 851 GTGCACTTTG AAATGACCTC TTTGGCGACT TTTTCTTGTA CTAATAATAA
 901 AGAGTGTGTT TGTATCATGT TGTAATTTTA TTTTAGAAAA AGTGAGGTAA
 951 GAAAGGAGTC CTTATGTTTA TTTCAATTAT TGAAAAATTA TTTGCATGTA
1001 TAATTGATTT CAACTGATGT TATTTAATCA CGTTTTTTCT AAAAAAAAAA
1051 AAAAAAAAAA AAAAAAAAAA GTACTCTGCG TTGTTACCAC TGCTTAATCG
1101 AATTC
```

FIGURE 127

```
  1  MALPSVTALN  IENNLFPPTV  TPPGSTNNFF  LGGAGERGLQ  IQDKFVKFTA
 51  IGVYLQDIAV  PYLATKWKGK  TAQELTETVP  FFRDIVTGPF  EKFMQVTMIL
101  PLTGQQYSEK  VSENCVAIWK  SLGIYTDEEA  KAIEKFVSVF  KDETFPPGSS
151  ILFTVLPKGL  GSLTISFSKD  GSIPETESAV  IENKLLSQAV  LESMIGAHGV
201  SPAAKQSLAT  RLSELFNEVG  DASN
```

FIGURE 128

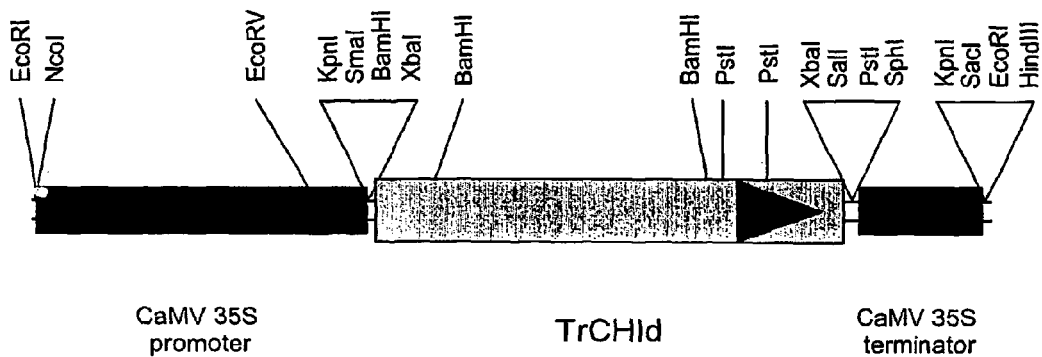
pDH51TrCHld sense
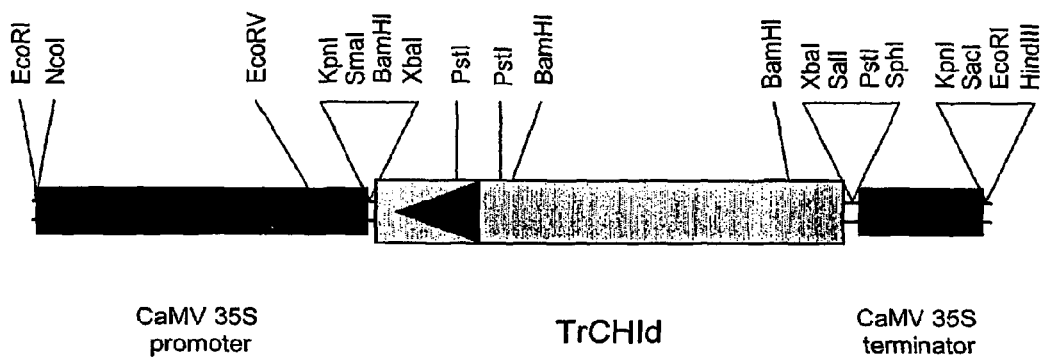
pDH51TrCHld anti
FIGURE 129

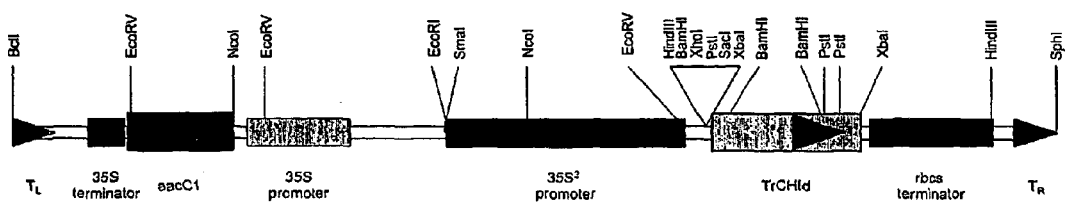
pPZP221:35S²TrCHld sense
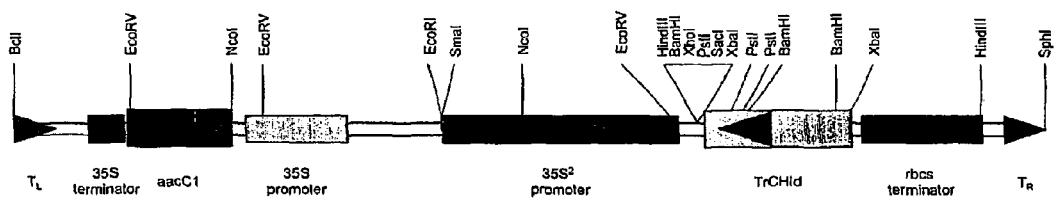
pPZP221:35S²TrCHld anti
FIGURE 130

```
   1 GAATTCGATT AAGCAGTGGT AACAACGCAG AGTACGCGGG GATTCAAACA
  51 TAGCTCAAAG TGTGTAACAA ATTTCTTAAC TTAAAACATT TTCAACCCAA
 101 CAAAAAAAAA CAAAGACAAA AACATGGGTA GTGTTGAAAT TCCAACAAAG
 151 GTTCTTACTA ACAGTTCTAG TCAAGTGAAA ATGCCTGTGG TTGGAATGGG
 201 ATCAGCACCT GATTTCACAT GTAAGAAAGA CACAAAAGAT GCAATCATTG
 251 AAGCCATCAA ACAGGGTTAT AGACACTTTG ATACTGCTGC TGCTTATGGC
 301 TCAGAACAAG CTCTTGGTGA AGGTTTGAAA GAAGCAATTG AACTTGGTCT
 351 TGTCACTAGA GAAGACCTTT TTGTTACTTC TAAACTTTGG GTCACTGAAA
 401 ATCATCCTCA TCTTGTTGTT CCTGCTCTTC AAAAATCTCT CAAGACTCTT
 451 CAATTGGAGT ACTTGGACTT GTATTTGATC CATTGGCCAC TTAGTTCTCA
 501 GCCTGGAAAG TTTTCATTTC CAATTGATGT GGCAGATCTC TTGCCATTTG
 551 ATGTGAAGGG TGTTTGGGAA TCCATGGAAG AAGGCTTGAA ACTTGGACTC
 601 ACTAAAGCTA TTGGTGTTAG TAACTTCTCT GTCAAGAAAC TTCAAAATCT
 651 TGTCTCAGTT GCCACTGTTC TTCCTGCTGT CAATCAAGTG GAGATGAACC
 701 TTGCATGGCA ACAAAAGAAG CTTAGAGAAT TTGCAATGC AAATGGAATA
 751 GTGTTAACTG CATTTTCACC ATTGAGAAAA GGTGCAAGCA GGGGACCAAA
 801 TGAAGTTATG GAAAATGATA TGCTTAAAGA GATTGCAGAT GCTCATGGAA
 851 AGTCTGTTGC ACAAATTTCA TTGAGATGGT TATATGAACA AGGAGTCACT
 901 TTTGTTCCCA AGAGCTATGA TAAGGAAAGA ATGGGTCAAA ATTTGGCTAT
 951 CTTTGATTGG ACATTGGCAA AAGAAGATCA TGAGAAAATT GATCAAATTA
1001 AGCAGAACCG TTTGATCCCT GGACCAACCA AGCCAGGACT CAGTGACCTA
1051 TGGGATGATG AAATATAAAG TGGAAGATGT TAAAAGTCCC TTAAGCTCAC
1101 TCAATATCTA TCTATTGTGT ACTTTTTGCA TTTGGGGTTT GAAATTGAGT
1151 CACCCTTGTT TCTGTATCGA TTTAAAATTT AAATAATCAA TTTTTCATTA
1201 CAAAAAAAAA AAAAAAAAAA AAAAAAAAA AGTACTCTGC GTTGTTACCA
1251 CTGCTTAATC ACTAGTGAAT TC
```

FIGURE 132

```
  1 MGSVEIPTKV LTNSSSQVKM PVVGMGSAPD FTCKKDTKDA IIEAIKQGYR
 51 HFDTAAAYGS EQALGEGLKE AIELGLVTRE DLFVTSKLWV TENHPHLVVP
101 ALQKSLKTLQ LEYLDLYLIH WPLSSQPGKF SFPIDVADLL PFDVKGVWES
151 MEEGLKLGLT KAIGVSNFSV KKLQNLVSVA TVLPAVNQVE MNLAWQQKKL
201 REFCNANGIV LTAFSPLRKG ASRGPNEVME NDMLKEIADA HGKSVAQISL
251 RWLYEQGVTF VPKSYDKERM GQNLAIFDWT LAKEDHEKID QIKQNRLIPG
301 PTKPGLSDLW DDEI
```

FIGURE 133

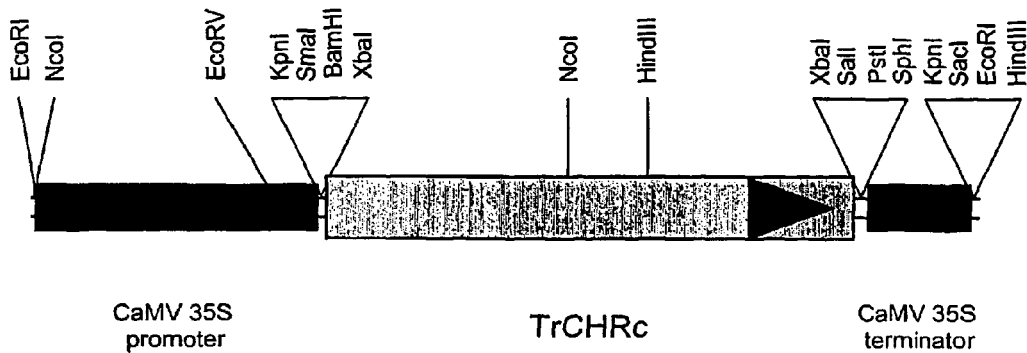
pDH51TrCHRc sense
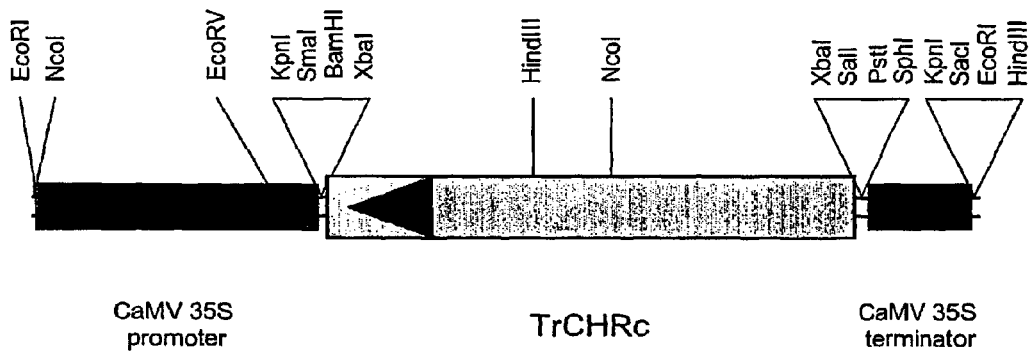
pDH51TrCHRc anti
FIGURE 134

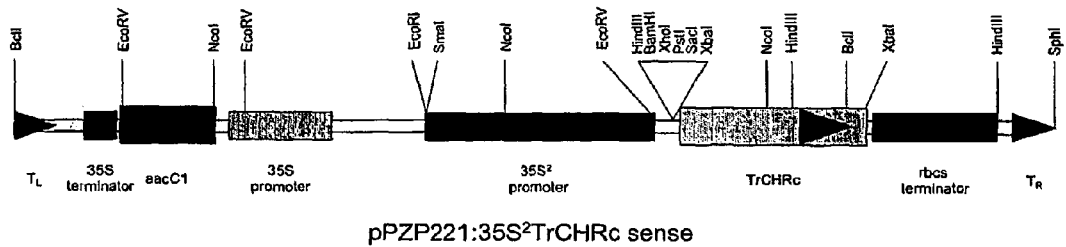
pPZP221:35S²TrCHRc sense
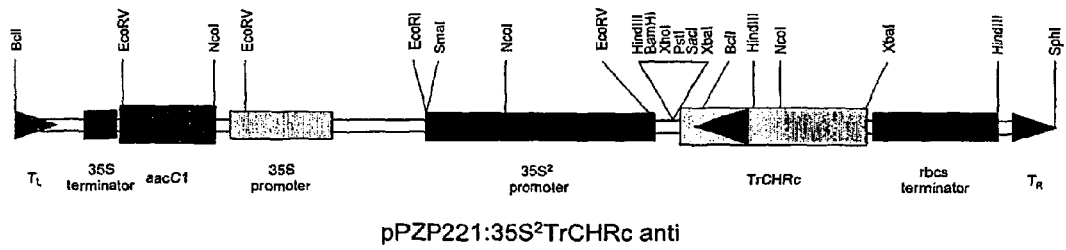
pPZP221:35S²TrCHRc anti
FIGURE 135

```
   1 GAATTCGATT AAGCAGTGGT ATCAACGCAG AGTACGCGGG GACAACAACT
  51 ATAACTTCCT GTTATTAACC AATTGAGTTC AAATTACATA CATAGCAGGA
 101 ACTATACTAA AGATATCAAC ATGGTTAGTG TTTCTGAAAT TCGCAAGGCT
 151 CAAAGGGCTG AAGGCCCTGC AACTATTTTG GCCATTGGTA CTGCAAATCC
 201 AGCAAATCGT GTTGACCAGA GTACATATCC TGATTTCTAC TTCAAAATCA
 251 CTAACAGTGA GCATAAGGTT GAGCTTAAAG AGAAATTTCA GCGCATGTGT
 301 GATAAATCTA TGATCAAGAG CAGATACATG TATCTAACAG AAGAGATTTT
 351 GAAAGAAAAT CCTAGTCTTT GTGAATACAT GGCACCTTCA TTGGATGCTA
 401 GGCAAGACAT GGTGGTGGTT GAGGTACCTA GACTTGGGAA GGAGGCTGCA
 451 GTGAAAGCTA TCAAAGAATG GGGTCAACCA AAGTCAAAGA TTACTCACTT
 501 AATCTTTTGC ACCACAAGTG GTGTTGACAT GCCTGGTGCC GATTACCAAC
 551 TCACAAAACT CTTAGGTCTT CGCCCATATG TGAAGAGGTA CATGATGTAC
 601 CAACAAGGGT GCTTTGCAGG TGGGACGGTT CTTCGTTTGG CCAAGGATTT
 651 GGCCGAGAAC AACAAAGGTG CTCGTGTGTT GGTTGTTTGC TCTGAAGTAA
 701 CCGCAGTCAC ATTCCGCGGC CCCAGTGACA CTCATTTGGA CAGTCTTGTT
 751 GGACAAGCAC TATTCGGAGA TGGAGCTGCT GCACTCATTG TTGGCTCAGA
 801 CCCAGTACCA GAAATTGAGA AGCCAATATT TGAGATGGTT TGGACCGCAC
 851 AGACAATTGC TCCAGATAGT GAAGGTGCCA TTGATGGTCA TCTTCGTGAA
 901 GCTGGACTAA CATTTCATCT TCTTAAAGAT GTTCCTGGGA TTGTCTCAAA
 951 GAACATTGAT AAGGCATTGG TTGAGGCATT CCAACCATTA AACATCTCTG
1001 ATTACAATTC AATCTTTTGG ATTGCTCATC CAGGTGGTCC TGCAATTCTA
1051 GACCAAGTTG AGATAAAGTT GGGCTTAAAA CCTGAAAAAA TGAAGGCCAC
1101 CAGAGATGTA CTTAGTGAAT ATGGTAACAT GTCAAGTGCA TGTGTATTGT
1151 TCATCTTAGA TGAGATGAGA AAGAAATCGG CTGAAAATGG ACTTAAAACC
1201 ACAGGAGAAG GACTTGACTG GGGTGTGTTG TTTGGATTTG GGCCCGGACT
1251 TACCATTGAA ACTGTTGTTC TACATAGTGT GGCTATATGA GAATGAGAGA
1301 CTTGATTTGT TTTTATTGTA TTGTATTGTA TTACTTTAAA TCTTGGTTGA
1351 ACCTCCATTT TAAGAATAAA TATGGAGTTC AATATGGACC ATCCTGTTAA
1401 AATAATATAT CGTTAATAGC TATTATTTTA GTGTCTGTTT CTTTTTACTA
1451 AACTATTTTA TTTTAGTATT TGTTTTGAC CAAAAAAAAA AAAAAAAAA
1501 AAAAAAGTA CTCTGCGTTG TTACCACTGC TTAATCACTA GTGAATTC
```

FIGURE 137

```
  1 MVSVSEIRKA QRAEGPATIL AIGTANPANR VDQSTYPDFY FKITNSEHKV
 51 ELKEKFQRMC DKSMIKSRYM YLTEEILKEN PSLCEYMAPS LDARQDMVVV
101 EVPRLGKEAA VKAIKEWGQP KSKITHLIFC TTSGVDMPGA DYQLTKLLGL
151 RPYVKRYMMY QQGCFAGGTV LRLAKDLAEN NKGARVLVVC SEVTAVTFRG
201 PSDTHLDSLV GQALFGDGAA ALIVGSDPVP EIEKPIFEMV WTAQTIAPDS
251 EGAIDGHLRE AGLTFHLLKD VPGIVSKNID KALVEAFQPL NISDYNSIFW
301 IAHPGGPAIL DQVEIKLGLK PEKMKATRDV LSEYGNMSSA CVLFILDEMR
351 KKSAENGLKT TGEGLDWGVL FGFGPGLTIE TVVLHSVAI
```

FIGURE 138

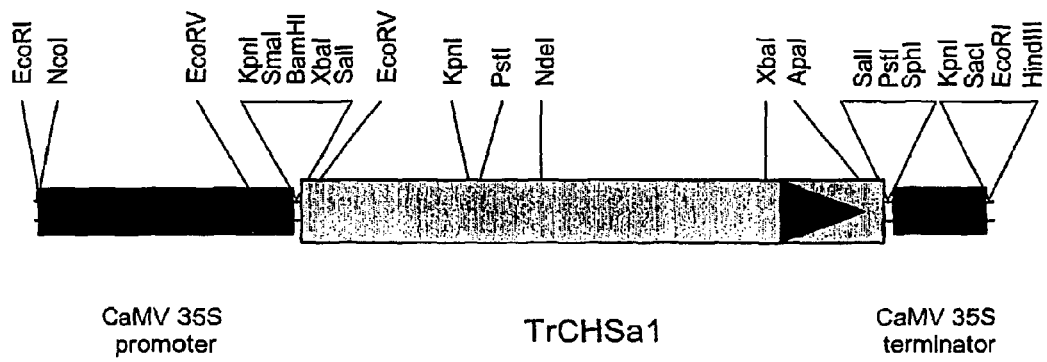
pDH51TrCHSa1 sense
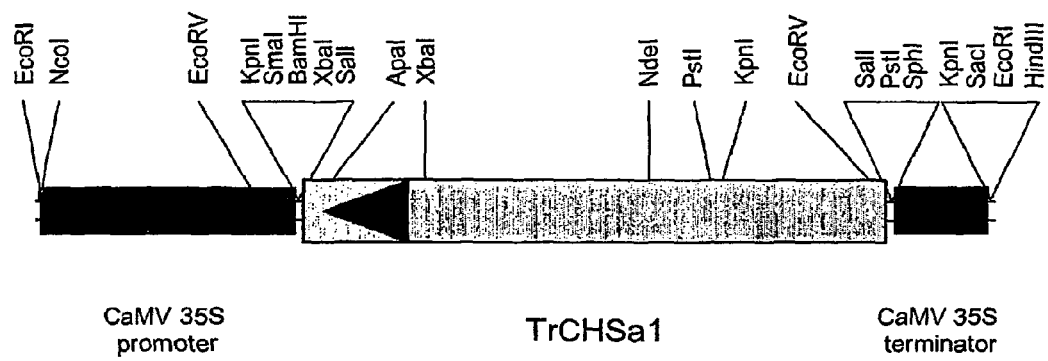
pDH51TrCHSa1 anti
FIGURE 139

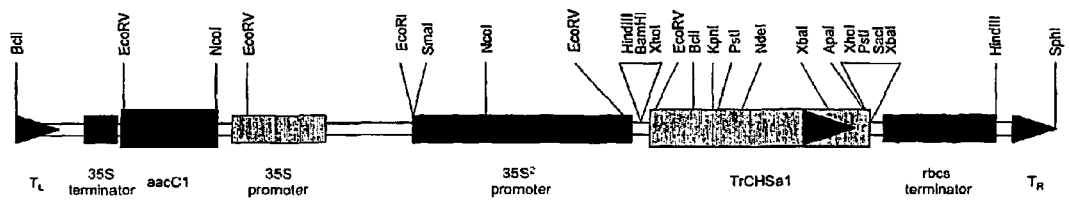
pPZP221:35S²TrCHSa1 sense
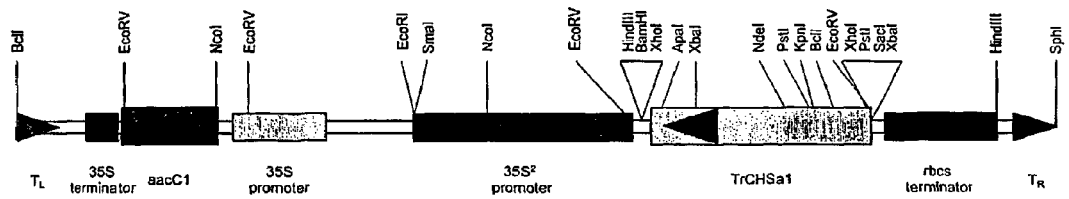
pPZP221:35S²TrCHSa1 anti
FIGURE 140

TrCHSa3

```
   1 GAATTCACTA GTGATTAAGC AGTGGTAACA ACGCAGAGTA CGCGGGGAAC
  51 AAAAACAACT ACGCATATTA TATATATATA TATATAGTCT ATAATTGAAA
 101 GAAACTGCTA AAGATATTAT TAAGATATGG TGAGTGTAGC TGAAATTCGC
 151 AAGGCTCAGA GGGCTGAAGG CCCTGCAACC ATTTTGGCCA TTGGCACTGC
 201 AAATCCACCA AACCGTGTTG AGCAGAGCAC ATATCCTGAT TTCTACTTCA
 251 AAATTACAAA CAGTGAGCAC AAGACTGAGC TCAAAGAGAA GTTCCAACGC
 301 ATGTGTGACA AATCCATGAT CAAGAGCAGA TACATGTATC TAACAGAAGA
 351 GATTTTGAAA GAAAATCCTA GTCTTTGTGA ATACATGGCA CCTTCATTGG
 401 ATGCTAGGCA AGACATGGTG GTGGTTGAGG TACCTAGACT TGGGAAGGAG
 451 GCTGCAGTCA AGGCCATTAA AGAATGGGGT CAACCAAAGT CAAAGATTAC
 501 TCACTTAATC TTTTGCACCA CAAGTGGTGT TGACATGCCT GGTGCTGATT
 551 ACCAACTCAC AAAACTCTTA GGTCTTCGCC CATATGTGAA AAGGTATATG
 601 ATGTACCAAC AAGGTTGTTT TGCAGGAGGC ACGGTGCTTC GTTTGGCAAA
 651 AGATTTGGCC GAGAACAACA AAGGTGCTCG TGTGCTAGTT GTTTGTTCTG
 701 AAGTCACCGC AGTCACATTT CGCGGCCCCA GTGATACTCA CTTGGACAGT
 751 CTTGTTGGAC AAGCATTGTT TGGAGATGGA GCCGCTGCAC TAATTGTTGG
 801 TTCTGATCCA GTGCCTGAAA TTGAGAAACC AATATTTGAG ATGGTTTGGA
 851 CTGCACAAAC AATTGCTCCA GACAGTGAAG GTGCCATTGA TGGTCATCTT
 901 CGTGAAGCTG GGCTAACATT TCATCTTCTT AAAGATGTTC CTGGGATTGT
 951 ATCAAAGAAC ATTAATAAAG CATTGGTTGA GGCTTTCCAA CCATTAGGAA
1001 TTTCTGACTA CAACTCAATC TTTTGGATTG CACACCCGGG TGGACCTGCA
1051 ATTCTTGATC AAGTAGAACA AAAGCTAGCC TTGAAGCCCG AAAAGATGAG
1101 GGCCACGAGG GAAGTTCTAA GTGAATATGG AAACATGTCA AGCGCATGTG
1151 TATTGTTCAT CTTAGATGAG ATGCGGAAGA AATCGGCTCA AAATGGACTT
1201 AAGACAACTG GAGAAGGACT TGATTGGGGT GTGTTGTTCG GCTTCGGACC
1251 AGGACTTACC ATTGAAACCG TTGTTCTTCG TAGCGTGGCT ATATAAGATG
1301 TGTGATTGTT TTTATTTTAA TGTATTACTT TTAATCTTGC TGCCTTGAAT
1351 TTCGATTTAA GAATAAATAA ATATATCTTT TGATAAAAAA AAAAAAAAA
1401 AAAAAAAAAA AAGTACTCTG CGTTGTTACC ACTGCTTAAT CGAATTC
```

FIGURE 142

```
  1  MVSVAEIRKA  QRAEGPATIL  AIGTANPPNR  VEQSTYPDFY  FKITNSEHKT
 51  ELKEKFQRMC  DKSMIKSRYM  YLTEEILKEN  PSLCEYMAPS  LDARQDMVVV
101  EVPRLGKEAA  VKAIKEWGQP  KSKITHLIFC  TTSGVDMPGA  DYQLTKLLGL
151  RPYVKRYMMY  QQGCFAGGTV  LRLAKDLAEN  NKGARVLVVC  SEVTAVTFRG
201  PSDTHLDSLV  GQALFGDGAA  ALIVGSDPVP  EIEKPIFEMV  WTAQTIAPDS
251  EGAIDGHLRE  AGLTFHLLKD  VPGIVSKNIN  KALVEAFQPL  GISDYNSIFW
301  IAHPGGPAIL  DQVEQKLALK  PEKMRATREV  LSEYGNMSSA  CVLFILDEMR
351  KKSAQNGLKT  TGEGLDWGVL  FGFGPGLTIE  TVVLRSVAI
```

FIGURE 143

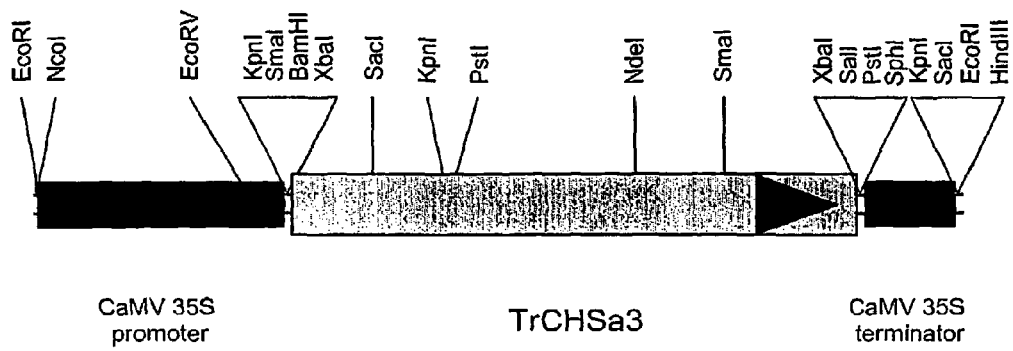
pDH51TrCHSa3 sense
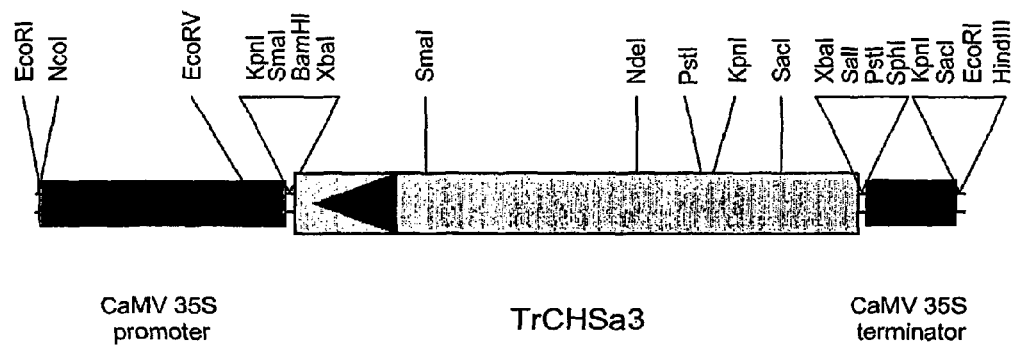
pDH51TrCHSa3 anti
FIGURE 144

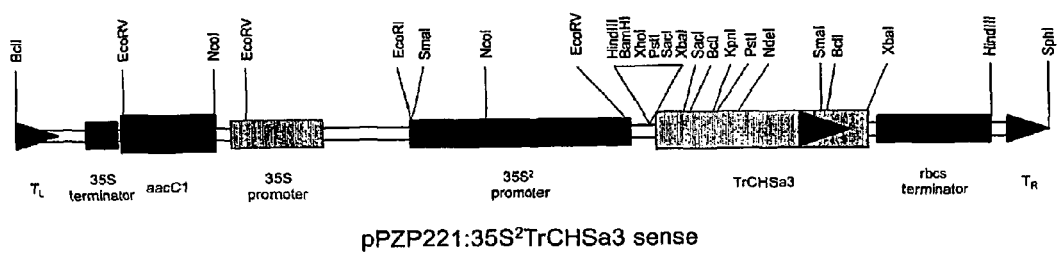
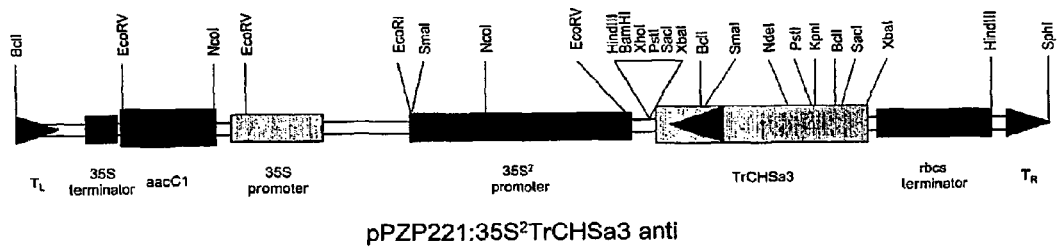
FIGURE 145

```
   1 GAATTCGATT AAGCAGTGGT AACAACGCAG AGTACGCGGG GATTCAATCT
  51 GTTGTGCATA AAATTCACTC ATTGCATAGA AAACCATACA CATTTGATCT
 101 TGCAAAGAAG AAATATGGGA GACGAAGGTA TAGTGAGAGG TGTCACAAAG
 151 CAGACAACCC CTGGGAAGGC TACTATATTG GCTCTTGGCA AGGCATTCCC
 201 TCACCAACTT GTGATGCAAG AGTGTTTAGT TGATGGTTAT TTTAGGGACA
 251 CTAATTGTGA CAATCCTGAA CTTAAGCAGA AACTTGCTAG ACTTTGTAAG
 301 ACAACCACGG TAAAACAAG GTATGTTGTT ATGAATGAGG AGATACTAAA
 351 GAAATATCCA GAACTTGTTG TCGAAGGCGC CTCAACTGTA AAACAACGTT
 401 TAGAGATATG TAATGAGGCA GTAACACAAA TGGCAATTGA AGCTTCCCAA
 451 GTTTGCCTAA AGAATTGGGG TAGATCCTTA TCGACATAA CTCATGTGGT
 501 TTATGTTTCA TCTAGTGAAG CTAGATTACC CGGTGGTGAC CTATACTTGT
 551 CAAAAGGACT AGGACTAAAC CCTAAAATTC AAAGAACCAT GCTCTATTTC
 601 TCTGGATGCT CGGGAGGCGT AGCCGGCCTT CGCGTTGCGA AAGACGTAGC
 651 TGAGAACAAC CCTGGAAGTA GAGTTTTGCT TGCTACTTCG GAAACTACAA
 701 TTATTGGATT CAAGCCACCA AGTGTTGATA GACCTTATGA TCTTGTTGGT
 751 GTGGCACTCT TTGGAGATGG TGCTGGTGCA ATGATAATTG GCTCAGACCC
 801 GGTATTTGAA ACTGAGACAC CATTGTTTGA GCTGCATACT TCAGCTCAGG
 851 AGTTTATACC AGACACCGAG AAGAAAATTG ATGGGCGGCT GACGGAGGAG
 901 GGCATAAGTT TCACACTAGC AAGGGAACTT CCGCAGATAA TCGAAGACAA
 951 TGTTGAGGGA TTCTGTAATA AACTAATTGA TGTTGTTGGG TTGGAGAATA
1001 AGGAGTACAA TAAGTTGTTT TGGGCTGTGC ATCCAGGTGG GCCTGCGATA
1051 TTGAATCGCG TGGAGAAGCG GCTTGAGTTG TCGCCGCAGA AGCTGAATGC
1101 TAGTAGAAAA GCTCTAATGG ATTATGGAAA TGCTAGCAGC AATACTATTG
1151 TTTATGTGCT GGAATATATG CTAGAAGAGG AAAAGAAGAT TAAAAAGGCG
1201 GGTGGAGGAG ATTCTGAATG GGGATTGATA CTTGCTTTTG GACCTGGAAT
1251 TACTTTTGAG GGGATTCTAG CAAGGAACTT GTGTGCATGA AGTCTTATAC
1301 AATTGTGATG CATGACTTAT ACTCTTATTT CTACTAATTA TTATATTAAG
1351 CAAATTCAGA ACTTTTAAGT AATGATTTAA TGAAGAATAC TTATAGTATA
1401 TTGACTTTAT TCACTTTCAA AGCAAGTTTA TGATCCTAAG ACATGGTAGA
1451 ACTTGAGCAT GTGGAATAGT TGTAACAAAA ACTCTAAGCA AATAGAGACT
1501 TTATGTAGTA TAAAGCATTT CCAGACATGA TAAATAATGG TACCTCAGAA
1551 CATAAAATAT ATTTAGCTAT CTTTCATCCC CAACTTTACA CATCCACCAA
1601 GGTACAGAAT AAGCATATGT CAACACAAAA TGTACTCTAA GTCTAACATG
1651 AGTAACCAAA CATGATGCCT GATTAAGTTA AAAGAAAAGA AAATCTGAGG
1701 GCATAGATCT TCAATCACAC CACTCCAGAG GGAAGGCGTA GAACAAGCTG
1751 TCCGCCGAAA ACACTGCAAT TCAATAAATA TCATTAGGAC AACAGTGCAG
1801 AGTCATGCGG GAAATGTCTT AAGTCACTGT ACTAAAAATA TAGGATTATA
1851 TTATGAACTA TACTAACCTT TTCACATAAT AGTAACAGAA ATCAGCTAAG
1901 ATGAATGTCT GGACAATTTC TGAGATAAGA ACCATGACGG CCATAAGCCA
1951 TACCCCAAGG CAACCAATAA ATGTCCACGG GTATCTAACA CCTGTTGCAA
2001 GAAATAGTAA GTTATTAGGA GATGTGCGGT TACGAAATTC AAGCTACACA
2051 ACAAAAGGAG GCCAGAACAA CAGCAATCTT GTAACCAGAT GACAACAATA
2101 AAATGTAAAC TTAAAGAGAC CGAACACACA AACATTGCAA CTCAGATGGA
2151 ATTGCTGCCA TGTAACTAGT AGGAGATTTG GGACGTCAAA TCAGTATATT
2201 ATGCAAATAC AAGGTATGAC CGCCTTGTCT ATTGTAGCAT ACAACAAACG
2251 TACAGTGGGT TTGTCCCTCT CAAAATGGCA GGATCTTTAC AGCACAATAT
2301 TTGGTTTTGT CATACTTATA CCATAAAAAA AAAAAAAAAA AAAAAAAAAA
2351 AAAGTACTCT GCGTTGTTAC CACTGCTTAA TCACTAGTGA ATTC
```

FIGURE 147

```
  1 MGDEGIVRGV TKQTTPGKAT ILALGKAFPH QLVMQECLVD GYFRDTNCDN
 51 PELKQKLARL CKTTTVKTRY VVMNEEILKK YPELVVEGAS TVKQRLEICN
101 EAVTQMAIEA SQVCLKNWGR SLSDITHVVY VSSSEARLPG GDLYLSKGLG
151 LNPKIQRTML YFSGCSGGVA GLRVAKDVAE NNPGSRVLLA TSETTIIGFK
201 PPSVDRPYDL VGVALFGDGA GAMIIGSDPV FETETPLFEL HTSAQEFIPD
251 TEKKIDGRLT EEGISFTLAR ELPQIIEDNV EGFCNKLIDV VGLENKEYNK
301 LFWAVHPGGP AILNRVEKRL ELSPQKLNAS RKALMDYGNA SSNTIVYVLE
351 YMLEEEKKIK KAGGGDSEWG LILAFGPGIT FEGILARNLC A
```

FIGURE 148

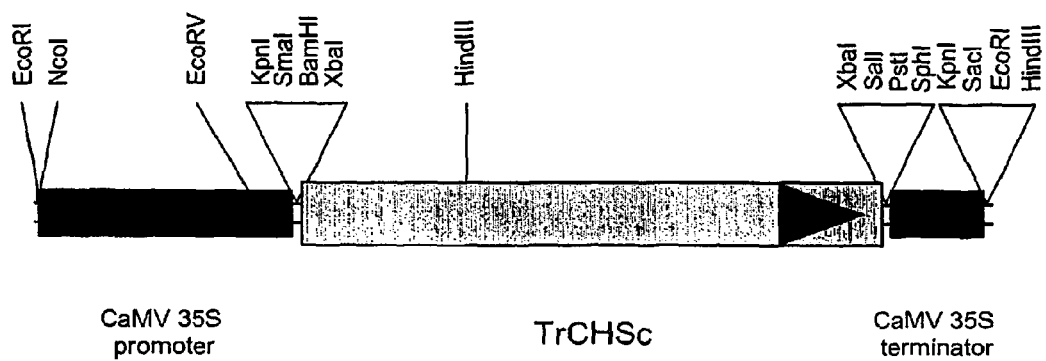
pDH51TrCHSc sense
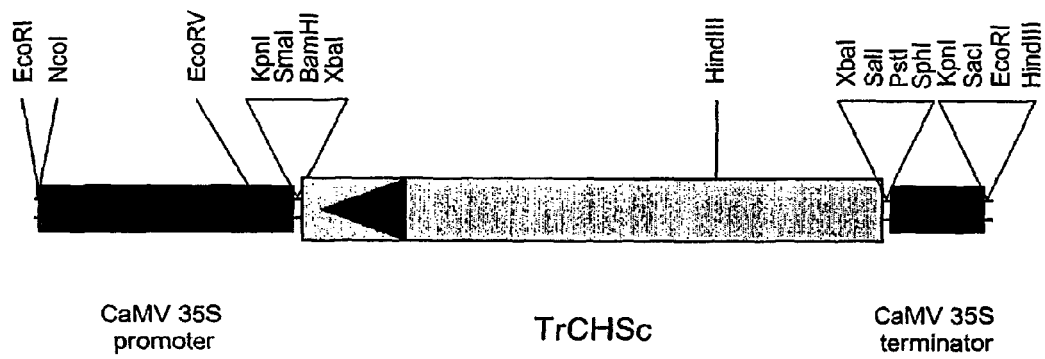
pDH51TrCHSc anti
FIGURE 149

TrCHSd2

```
   1 GAATTCGATT AAGCAGTGGT AACAACGCAG AGTACGCGGG GATAGCAACA
  51 CACACTTTGA TTTCTTTTTG AGTCCTTGCT ACGTGGCTTT ACCAAAAAAC
 101 GTTGCTAAGT CATCAACCAT TCCAATTCCT TAATATAACC TATCAGTACT
 151 CACCATCTTT TCTTCCTCCC TGCTAACTTT AGACTCAGAG AAGATGGTGA
 201 ATGTTAATGA GATCCGCCAG GCACAGAGAG CTGAAGGCCC TGCCACCGTG
 251 TTGGCAATCG GCACTGCAAC TCCTCCAAAC TGTGTCGATC AGAGTACATA
 301 CCCAGACTAC TACTTCCGCA TCACAAACAG TGAGCACAAG ACAGAGCTCA
 351 AAGAAAAATT CCAGCGCATG TGTGACAAAT CTATGATTAA GAAGAGATAC
 401 ATGCATTTGA CAGAAGAGAT TTTGAAGGAG AATCCAAGTT TATGTGAGTA
 451 CATGGCACCT TCATTGGATG CAAGACAAGA CATGGTGGTT GTGGAAGTAC
 501 CAAGGCTAGG AAAAGAGGCT GCAACAAAGG CTATCAAGGA ATGGGGTCAA
 551 CCTAAGTCCA AGATTACTCA CCTCATCTTT TGCACCACAA GTGGTGTGGA
 601 CATGCCTGGC GCCGACTATC AGCTTACAAA GCTTTTAGGC CTTCGTCCGC
 651 ATGTGAAGCG TTATATGATG TACCAACAAG GTTGTTTCGC TGGTGGTACG
 701 GTGCTTCGTT TGGCTAAAGA CTTGGCTGAA AACAACAAAG GTGCCCGTGT
 751 GTTGGTGGTT TGTTCAGAGA TCACTGCGGT TACTTTCCGT GGACCCAGTG
 801 ACACTCATCT TGATAGCCTT GTGGGGCAAG CATTGTTTGG AGATGGTGCA
 851 GCAGCTGTGA TTGTAGGTTC AGACCCATTA CCACAAGTTG AGAAGCCCTT
 901 GTTTGAATTG GTATGGACTG CTCAAACAAT CCTTCCAGAC AGTGAAGGAG
 951 CCATTGATGG GCACCTTCGT GAAGTCGGGC TGACATTCCA TCTCCTCAAG
1001 GATGTTCCTG GACTCATCTC AAAGAACATT GAGAAAGCTC TTGTTGAGGC
1051 CTTTCAACCT TTAGGTATCT CTGATTACAA TTCTATATTT TGGATCGCAC
1101 ATCCTGGTGG ACCTGCAATT CTGGACCAAG TGGAAGCCAA ATTAAGCTTA
1151 AAGCCAGAGA AAATGCAAGC CACCCGGCAT GTGCTTAGCG AGTATGGTAA
1201 CATGTCAAGT GCATGTGTGT TATTTATCTT GGATGAGATG AGGAGGAAGT
1251 CAAAAGAAGA TGGACTTGCC ACAACAGGCG AGGGGCTGGA ATGGGGTGTA
1301 CTATTCGGTT TTGGACCCGG ACTACTGTT GAGACTGTAT TGCTCCATAG
1351 TGTTGCCACT TAAATTGCCT AGATATGCTA TAACTATATG CTTATTTAAT
1401 TCTTTGTTTC TGGGGATTT TATCTTCACT TACTTCACTG AGCATTTGAA
1451 TAAAGTTTGT TTTAATTATT CATAATGTAA TATGGTGTTG CTTAATGTAC
1501 CCATCCATAT AATATTTGTA ATACATATAT TAATCAACTT GCAATTTCAT
1551 GAAAAAAAAA AAAAAAAAAA AAAAAAAAAA AAAAAAAAAA AAGGAAAAAA
1601 AAAAAAAAAA AAAAAAAAAA AAGTACTCTG CGTTGTTACC ACTGCTTAAT
1651 CACTAGTGAA TTC
```

FIGURE 152

```
  1 MVNVNEIRQA QRAEGPATVL AIGTATPPNC VDQSTYPDYY FRITNSEHKT
 51 ELKEKFQRMC DKSMIKKRYM HLTEEILKEN PSLCEYMAPS LDARQDMVVV
101 EVPRLGKEAA TKAIKEWGQP KSKITHLIFC TTSGVDMPGA DYQLTKLLGL
151 RPHVKRYMMY QQGCFAGGTV LRLAKDLAEN NKGARVLVVC SEITAVTFRG
201 PSDTHLDSLV GQALFGDGAA AVIVGSDPLP QVEKPLFELV WTAQTILPDS
251 EGAIDGHLRE VGLTFHLLKD VPGLISKNIE KALVEAFQPL GISDYNSIFW
301 IAHPGGPAIL DQVEAKLSLK PEKMQATRHV LSEYGNMSSA CVLFILDEMR
351 RKSKEDGLAT TGEGLEWGVL FGFGPGLTVE TVLLHSVAT
```

FIGURE 153

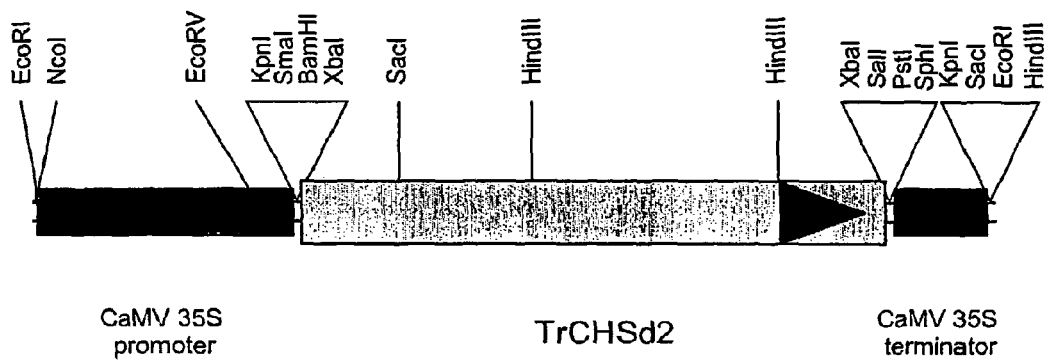
pDH51TrCHSd2 sense
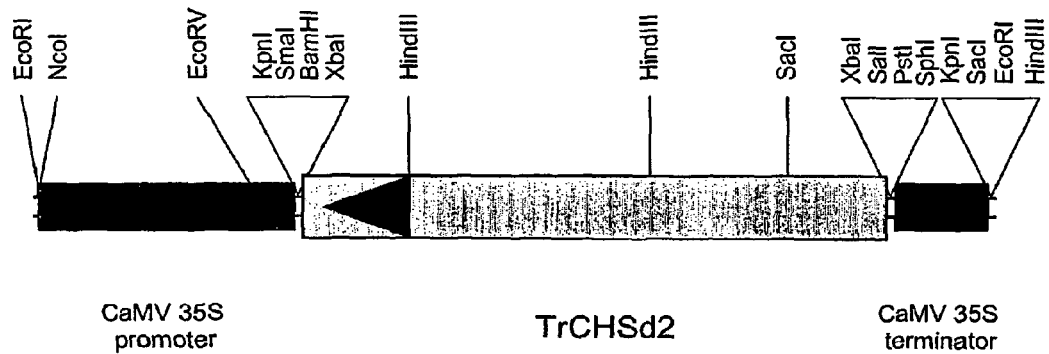
pDH51TrCHSd2 anti
FIGURE 154

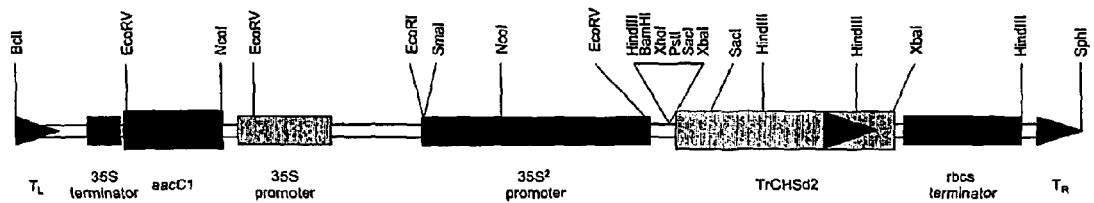
pPZP221:35S²TrCHSd2 sense
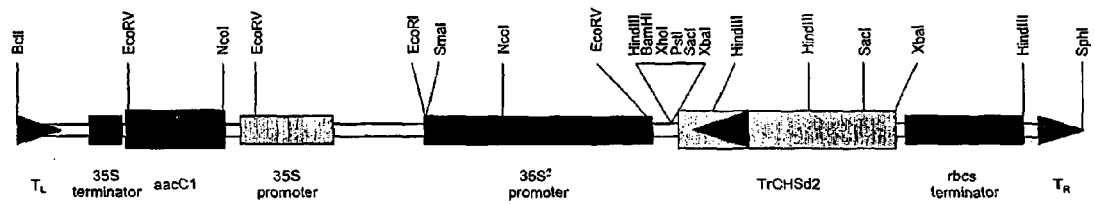
pPZP221:35S²TrCHSd2 anti
FIGURE 155

```
   1 GAATTCGATT AAGCAGTGGT AACAACGCAG AGTACGCGGG ACTAAGCCTT
  51 GATTCATTGT TTGTTTCCAT AACACAAGAA CTAGTGTTTG CTTGAATCTT
 101 AAGAAAAAAT GCCTCAAGGT GATTTGAATG GAAGTTCCTC GGTGAATGGA
 151 GCACGTGCTA GACGTGCTCC TACTCAGGGA AAGGCAACGA TACTTGCATT
 201 AGGAAAGGCT TTCCCCGCCC AGGTCCTCCC TCAAGAGTGC TTGGTGGAAG
 251 GATTCATTCG CGACACTAAG TGTGACGATA CTTATATTAA GGAGAAATTG
 301 GAGCGTCTTT GCAAAAACAC AACTGTGAAA ACAAGATACA CAGTAATGTC
 351 AAAGGAGATC TTAGACAACT ATCCAGAGCT AGCCATAGAT GGAACACCAA
 401 CAATAAGGCA AAAGCTTGAA ATAGCAAATC CAGCAGTAGT TGAAATGGCA
 451 ACAAGAGCAA GCAAAGATTG CATCAAAGAA TGGGGAAGGT CACCTCAAGA
 501 TATCACACAC ATAGTCTATG TTTCCTCGAG CGAAATTCGT CTACCCGGTG
 551 GTGACCTTTA TCTTGCAAAT GAACTCGGCT TAAACAGCGA TGTTAATCGC
 601 GTAATGCTCT ATTTCCTCGG TTGCTACGGC GGTGTCACTG GCTTACGTGT
 651 CGCCAAAGAC ATCGCCGAAA ATAACCCTGG TAGTAGGGTG TTACTCACAA
 701 CATCCGAGAC CACTATTCTC GGTTTTCGAC CACCGAGTAA AGCTAGACCT
 751 TATGACCTCG TTGGCGCTGC ACTTTTCGGT GATGGCGCCG CTGCTGCAAT
 801 AATTGGAACA GACCCTATAT TGAATCAAGA ATCACCTTTC ATGGAATTGA
 851 ACCATGCAGT CCAAAAATTC TTGCCTGATA CACAAAATGT GATTGATGGT
 901 AGAATCACTG AAGAGGGTAT TAATTTTAAG CTTGGAAGAG ACCTTCCTCA
 951 AAAAATTGAA GACAATATTG AAGAATTTTG CAAGAAAATT ATGGCTAAAA
1001 GTGATGTTAA GGAATTTAAT GACTTATTTT GGGCTGTTCA TCCTGGTGGG
1051 CCAGCTATAC TCAATAAGCT AGAAAATATA CTCAAATTGA AAAGTGATAA
1101 ATTGGATTGT AGTAGGAAGG CATTAATGGA TTATGGAAAT GTTAGTAGCA
1151 ATACTATATT CTATGTGATG GAGTATATGA GAGATTATTT GAAGGAAGAT
1201 GGAAGTGAAG AATGGGGATT AGGATTGGCT TTTGGACCAG GGATTACTTT
1251 TGAAGGGGTT CTCCTCCGTA GCCTTTAATC TTGAAATAAT AATTCATATG
1301 AAATTACTTG TCTTAAGATT GTGATAGGAA GATGAATATG TATTGGATTA
1351 ATATTGATAT GGTGTTATTT TAAGTTGATT TTAAAAAAG TTTATTAATA
1401 AAGTATGATG TAACAATTGT TGTTTGAATG TTAAAAGGGA AGTATACTAT
1451 TTTAAGTTCT TGACCATACT GATTTTTCT TTACACATTT TCATATCTAA
1501 AATTGTTCTA TGATATCTTC ATTGTTGATA CTGTAATAAT ATAATATCTA
1551 ATTTGGCTGG CAAAATGAAA GATTTTTCAC CGAAAAAAA AAAAAAAAAA
1601 AAAAAAAAAA AAGTACTCTG CGTTGTTACC ACTGCTTAAT CACTAGTGAA
1651 TTC
```

FIGURE 157

```
  1  MPQGDLNGSS  SVNGARARRA  PTQGKATILA  LGKAFPAQVL  PQECLVEGFI
 51  RDTKCDDTYI  KEKLERLCKN  TTVKTRYTVM  SKEILDNYPE  LAIDGTPTIR
101  QKLEIANPAV  VEMATRASKD  CIKEWGRSPQ  DITHIVYVSS  SEIRLPGGDL
151  YLANELGLNS  DVNRVMLYFL  GCYGGVTGLR  VAKDIAENNP  GSRVLLTTSE
201  TTILGFRPPS  KARPYDLVGA  ALFGDGAAAA  IIGTDPILNQ  ESPFMELNHA
251  VQKFLPDTQN  VIDGRITEEG  INFKLGRDLP  QKIEDNIEEF  CKKIMAKSDV
301  KEFNDLFWAV  HPGGPAILNK  LENILKLKSD  KLDCSRKALM  DYGNVSSNTI
351  FYVMEYMRDY  LKEDGSEEWG  LGLAFGPGIT  FEGVLLRSL
```

FIGURE 158

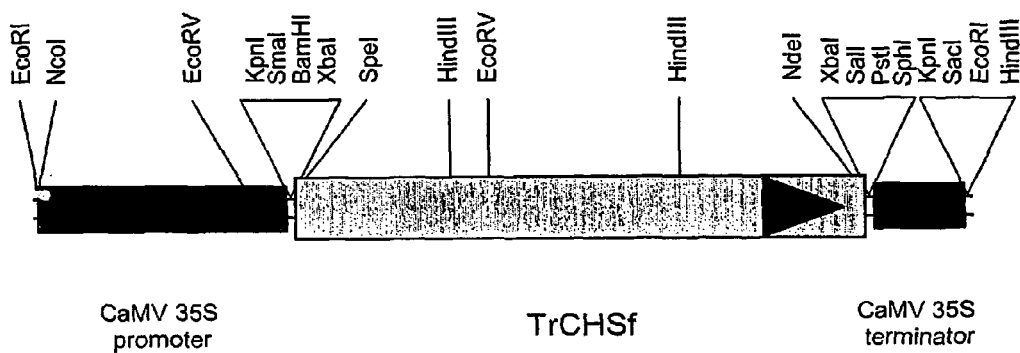
pDH51TrCHSf sense
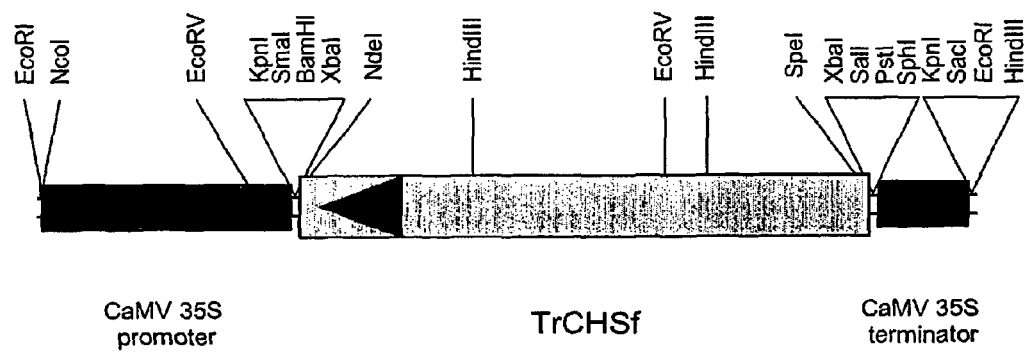
pDH51TrCHSf anti
FIGURE 159

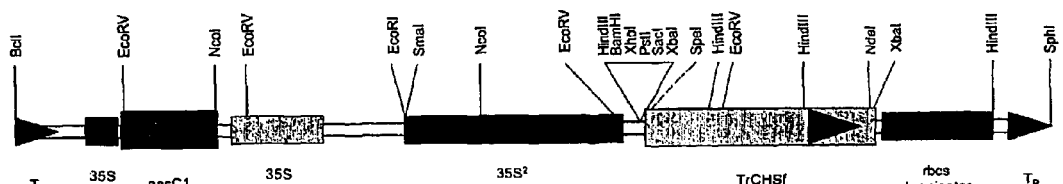
pPZP221:35S²TrCHSf sense
pPZP221:35S²TrCHSf anti
FIGURE 160

TrCHSh

```
   1 GAATTCACTA GTGATTAAGC AGTGGTAACA ACGCAGAGTA CGCGGGGGAA
  51 TCCACCAAAT CAACACCATT AATAACCTTC CAAATTCTCG TTACCTCACC
 101 AAATCTCATT TTTCATTATA TATCTTGGGT ACATCTTTTG TTACCTCCAA
 151 CAAAAAAATG GTGACCGTAG AAGAGATTCG TAACGCCCAA CGTTCAAATG
 201 GCCCTGCCAC TATCTTAGCT TTTGGCACAG CCACTCCTTC TAACTGTGTC
 251 ACTCAAGCTG ATTATCCTGA TTACTACTTT CGTATCACCA ACAGCGAACA
 301 TATGACTGAT CTTAAGGAAA AATTCAAGCG GATGTGTGAT AGATCAATGA
 351 TAAAGAAACG TTACATGCAC CTAACAGAAG ACTTTCTGAA GGAGAATCCA
 401 AATATGTGTG AATACATGGC ACCATCACTA GATGTAAGAC GAGACATAGT
 451 GGTTGTTGAA GTACCAAAGC TAGGTAAAGA AGCAGCAAAA AAAGCCATAT
 501 GTGAATGGGG ACAACCAAAA TCCAAAATCA CACATCTTGT TTTCTGCACC
 551 ACTTCCGGTG TTGACATGCC GGGAGCCGAT TACCAACTCA CCAAACTTTT
 601 AGGCTTAAAA CCTTCTGTCA AGCGTCTCAT GATGTATCAA CAAGGTTGTT
 651 TCGCTGGCGG CACAGTTCTC CGCTTAGCAA AAGACCTTGT TGAGAATAAC
 701 AAAAATGCAA GAGTTCTTGT TGTTTGTTCT GAAATTACTG CGGTTACTTT
 751 TCGTGGACCA TCGGATACTC ATCTTGATTC GCTCGTGGGA CAGGCGCTTT
 801 TTGGTGATGG AGCCGCAGCA ATGATTATTG GTGCGGATCC TGATTTAACC
 851 GTGGAGCGTC CGATTTTCGA GATTGTTTCG GCTGCTCAGA CTATTCTTCC
 901 TGATTCTGAT GGCGCAATTG ATGGACATCT TCGTGAAGTG GGGCTCACTT
 951 TTCATTTATT GAAAGATGTT CCGGGGATTA TTTCAAAGAA CATTGAAAAA
1001 AGTTTAGTTG AAGCTTTTGC GCCTATTGGG ATTAATGATT GGAACTCAAT
1051 ATTTGGGTT GCACATCCAG GTGGACCGGC TATTTTAGAC CAGGTTGAAG
1101 AGAAACTCCA TCTTAAAGAG GAGAAACTCC GGTCCACCCG GCATGTGCTT
1151 AGTGAATATG GAAATATGTC AAGTGCATGT GTTTTATTTA TTTTGGATGA
1201 AATGAGAAAG AGGTCTAAAG AGGAAGGGAT GATTACAACT GGTGAAGGGT
1251 TGGAATGGGG TGTGTTGTTT GGGTTTGGAC CGGGTTTAAC TGTTGAAACC
1301 GTTGTGCTTC ATAGTGTTCC GGTTCAGGGT TGAATTTATT ATACATAGAT
1351 TGGAAAATAA AATTTGCCTG CCGAGAGATG TGAACTAACT TTGTAGGCAA
1401 GCTCAAATTA AAGTTTGAGA TAATATTGTG CTTTAGTTAT TATGGTATGT
1451 AATGTAATGT TTTTACTTTT TTCGAAATTC ATGTAATTTG ATATGTAAAG
1501 TAATATGTTT GGGTTGGAAT ATAATTATTT GTTAACTAAA AAAAAAAAA
1551 AAAAAAAAAA AAAAAGTACT CTGCGTTGTT ACCACTGCTT AATCGAATTC
```

FIGURE 162

```
  1 MVTVEEIRNA QRSNGPATIL AFGTATPSNC VTQADYPDYY FRITNSEHMT
 51 DLKEKFKRMC DRSMIKKRYM HLTEDFLKEN PNMCEYMAPS LDVRRDIVVV
101 EVPKLGKEAA KKAICEWGQP KSKITHLVFC TTSGVDMPGA DYQLTKLLGL
151 KPSVKRLMMY QQGCFAGGTV LRLAKDLVEN NKNARVLVVC SEITAVTFRG
201 PSDTHLDSLV GQALFGDGAA AMIIGADPDL TVERPIFEIV SAAQTILPDS
251 DGAIDGHLRE VGLTFHLLKD VPGIISKNIE KSLVEAFAPI GINDWNSIFW
301 VAHPGGPAIL DQVEEKLHLK EEKLRSTRHV LSEYGNMSSA CVLFILDEMR
351 KRSKEEGMIT TGEGLEWGVL FGFGPGLTVE TVVLHSVPVQ G
```

FIGURE 163

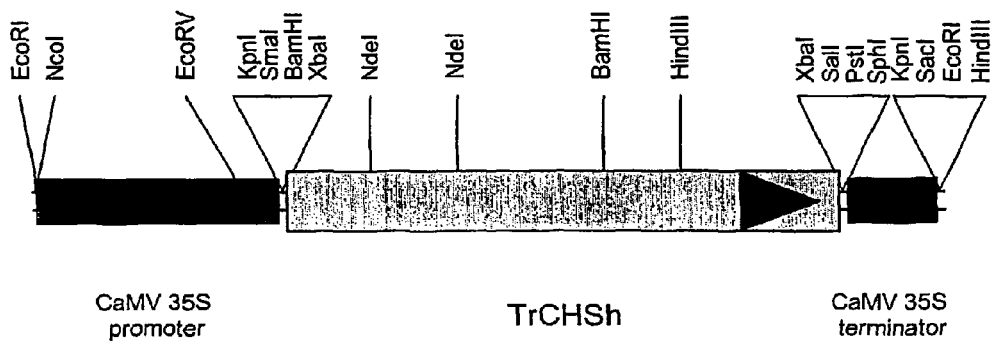
pDH51TrCHSh sense
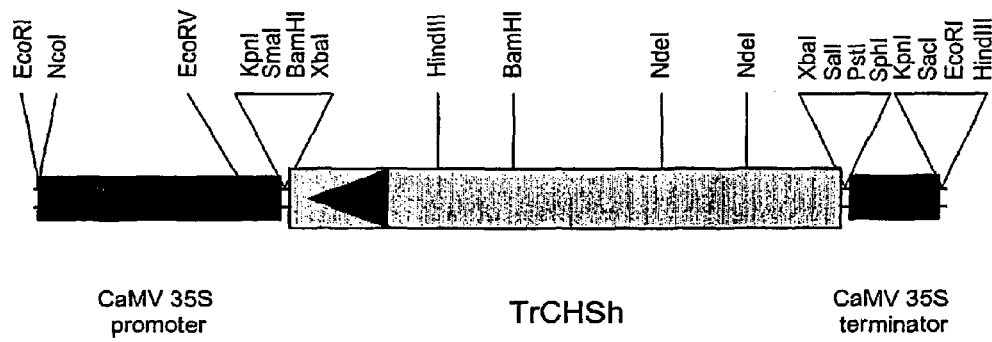
pDH51TrCHSh anti
FIGURE 164

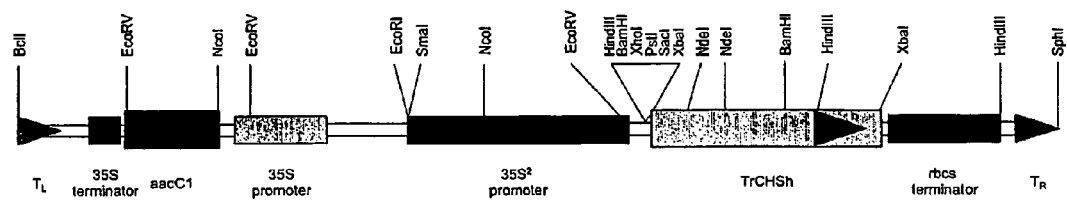
pPZP221:35S²TrCHSh sense
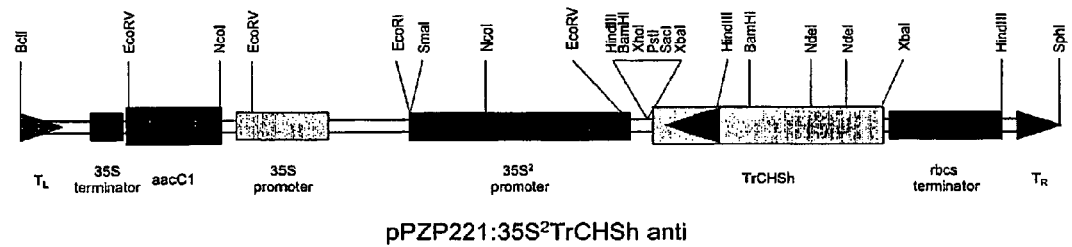
pPZP221:35S²TrCHSh anti
FIGURE 165

```
   1 GAATTCACTA GTGATTAAGC AGTGGTAACA ACGCAGAGTA CGCGGGGGTG
  51 ACTTGATCTA GCAGTTATCA AACACAACAG TCTTCCACTT GAGCTCTGTT
 101 TCTCCACATG TCGAAGCTAG TTTGCGTCAC CGGCGGCAGC GGATGCATCG
 151 GTTCATGGCT AGTCCATCTC CTTCTCCTCC GCGGCTACAC TGTTCACGCC
 201 ACCGTCCAAA ATCTCAATGA TGAGAACGAA ACGAAGCATC TAGAAGCTCT
 251 CGAAGGAGCA CAAACTAATC TCCGTCTCTT CCAGATCGAT CTCCTTAACT
 301 ACGACACAAT CCTCGCTGCT GTCCGCGGTT GCGTCGGAAT TTTCCACCTC
 351 GCTTCACCTT GCACTGTAGA CAAAGTTCAT GATCCTCAGA AGGAGCTTTT
 401 GGATCCTGCA ATTAAAGGGA CTTTGAATGT GCTTACTGCA GCTAAGGAAG
 451 TAGGGGTGAA GCGTGTGGTT GTTACCTCGT CTGTCTCGGC GATTACTCCT
 501 AGTCCTGATT GGCCTTCTGA TGTTGTTAAA AGAGAGGATT GTTGGACTGA
 551 TGTTGAATAT TGCAAGAAAA AAGAGTTGTG GTATCCGTTG TCCAAAACAT
 601 TGGCTGAGAA AGCTGCGTGG GATTTTTCCA AGAAAATGG TTTGGATGTT
 651 GTTGTGGTGA ATCCCGGTAC TGTGATGGGT CCTGTTATTC CACCACGGCA
 701 TAATGCAAGC ATGCTCATGC TTGTGAGACT TCTTGAAGGC TGCGCTGAAA
 751 CATTTGAAGA CTATTTTATG GGATTGGTCC ACTTCAAAGA TGTAGCATTG
 801 GCGCATATTT TGGTGTATGA GAACAAAGAA GCATCTGGTA GACATGTGTG
 851 TGTTGAAACT ATCTCTCACT ACGGTGATTT TGTGGCAAAA GTTGCTGAAC
 901 TTTATCCAGA ATATAGTGTT CCTAGGATGC AGCGAGATAC GCAACCTGGA
 951 TTGTTGAGAG CGAATGATGG ATCAAAGAAG CTCATAGATT TGGGTTTGGA
1001 ATTCATTCCA ATGGAGCAAA TTATCAAGGA TGCTGTAGAG AGTTTGAAGA
1051 ACAAAGGATT CATTTCTTGA ATGATGTTAC TGTTCTTTGG AGAACCCTAT
1101 AGTTACCAGA GTATAGACTA AATAATATAT AGGTGATGGG TCAGAGAATG
1151 AGTACTTATG TCATGAGTTG TGTCTGTATA ATATGTTTTC TCAATTCTTA
1201 TATGTTAAAT TGCTAATGTT AACTTCAATA TTTATCAGCC AGTATTGTTT
1251 TTTTAATAAA ATATTGAAGC AAAAAAAAAA AAAAAAAAAA AAAAAAAGT
1301 ACTCTGCGTT GTTACCACTG CTTAATCGAA TTC
```

FIGURE 167

```
  1  MSKLVCVTGG  SGCIGSWLVH  LLLLRGYTVH  ATVQNLNDEN  ETKHLEALEG
 51  AQTNLRLFQI  DLLNYDTILA  AVRGCVGIFH  LASPCTVDKV  HDPQKELLDP
101  AIKGTLNVLT  AAKEVGVKRV  VVTSSVSAIT  PSPDWPSDVV  KREDCWTDVE
151  YCKKKELWYP  LSKTLAEKAA  WDFSKENGLD  VVVVNPGTVM  GPVIPPRHNA
201  SMLMLVRLLE  GCAETFEDYF  MGLVHFKDVA  LAHILVYENK  EASGRHVCVE
251  TISHYGDFVA  KVAELYPEYS  VPRMQRDTQP  GLLRANDGSK  KLIDLGLEFI
301  PMEQIIKDAV  ESLKNKGFIS
```

FIGURE 168

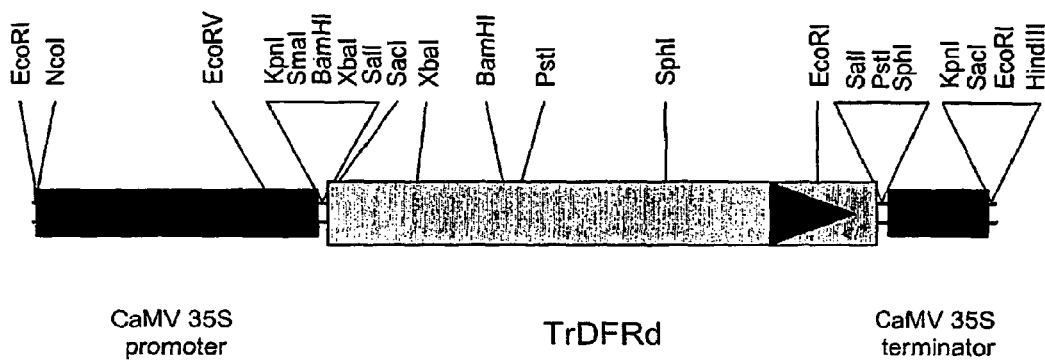
pDH51TrDFRd sense
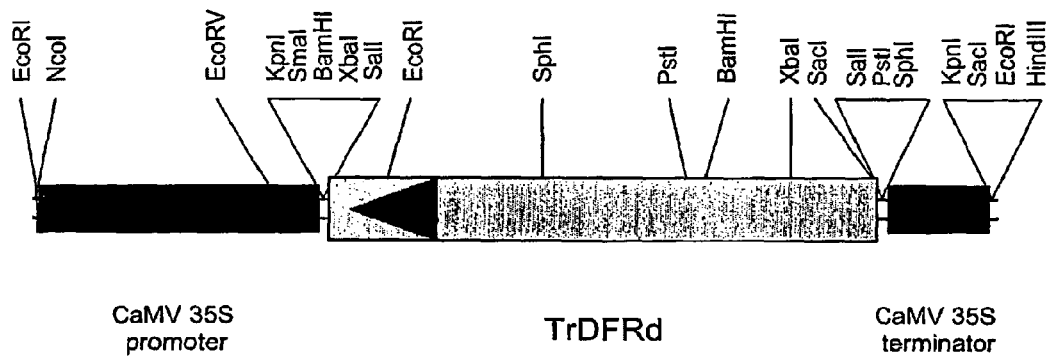
pDH51TrDFRd anti
FIGURE 169

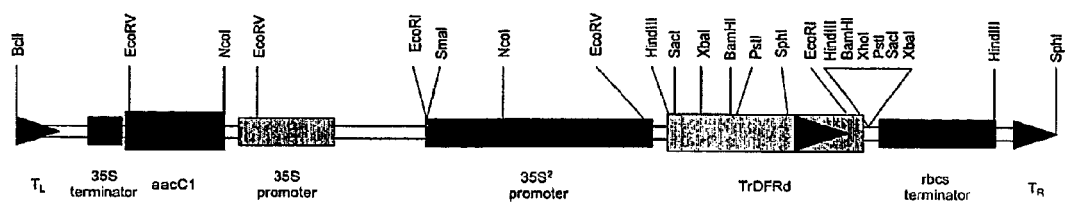
pPZP221:35S²TrDFRd sense
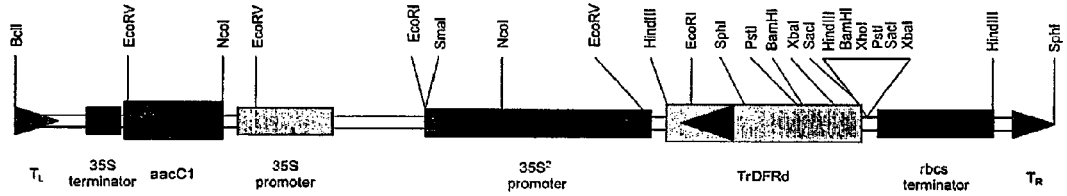
pPZP221:35S²TrDFRd anti
FIGURE 170

```
   1 GAATTCGATT AAGCAGTGGT AACAACGCAG AGTACGCGGG GACCACTCTA
  51 TTTATTTCTA CTTAAACCTC ACAAAAAATA AACCACACAA CACACAAACA
 101 CCAAAAACAG AGCACCGTTT CCATCATCAA ACAATGGCAC CAGCCAAAAC
 151 TCTAAGTTAT CTCTCACAAC AAAACACTCT CGAGTCAAGT TTCGTTAGGG
 201 AAGAAGATGA GCGTCCAAAA GTTGCCTACA ATAACTTCAG CAACGAGATT
 251 CCAATCATTT CTCTTGCTGG AATTGATGAG GTTGATGGTC GTAGAACAGA
 301 GATATGTAAC AAGATTGTTG AAGCTTGTGA GAATTGGGGT ATTTTTCAGG
 351 TTGTTGATCA TGGTGTTGAT ACAAAACTTG TTTCTGAGAT GACCCGTTTT
 401 GCTAGAGAGT TTTTTGCTTT GCCACCGGAA GAGAAGCTCC GGTTTGACAT
 451 GTCCGGTGGT AAAAAGGGTG GTTTCATTGT CTCTAGTCAT CTTCAAGGAG
 501 AAGCAGTGAA GGATTGGAGA GAGCTAGTGA CATATTTTTC ATACCCAATT
 551 AAACAAAGAG ATTATTCAAG GTGGCCAGAC AAGCCAGAAG GATGGAAAGA
 601 GGTAACAGAA AAATACAGTG AAAACCTAAT GAATTTAGCT TGCAAGCTAT
 651 TGGAAGTTTT ATCAGAAGCA ATGGGTTTAG AAAAAGAAGC TCTAACAAAA
 701 GCATGTGTTG ATATGGATCA AAAAGTTGTT ATAAATTATT ACCCAAAATG
 751 CCCTGAACCT GACCTCACAC TTGGCCTTAA ACGTCACACT GACCCTGGCA
 801 CAATTACTCT TTTGCTTCAA GATCAAGTTG GTGGTCTTCA AGCTACCAAA
 851 GATAATGGTA AGACGTGGAT TACAGTTCAA CCAGTTGAAG GTGCTTTTGT
 901 TGTTAATCTT GGAGACCATG GTCACTATCT AAGTAATGGA CGGTTCAAAA
 951 ATGCTGACCA TCAAGCAGTG GTGAATTCGA ACTACAGCCG TTTATCAATA
1001 GCAACATTTC AAAATCCAGC TCCAGATGCA ACTGTGTACC CTTTGAAGAT
1051 TAGAGATGGT GAAAATCTG TGTTGGAAGA ACCAATCACT TTTGCTGAAA
1101 TGTATAGAAG GAAGATGACC AAAGACCTTG AAATTGCTAG GATGAAGAAG
1151 TTGGCTAAGG AACAACAACT TAGGGACTTG GAGGAGAACA AGACTAAATA
1201 TGAGGCCAAA CCTTTGAATG AGATCTTTGC TTAATTAATT AGTCTTAATT
1251 TAAATAATAA ATTTTAGACT TAATTTACAT ATAATAATTT TAATTTTTTG
1301 TTCAATTAAT CTATGTTTAA TTTGTCGTTA TTGTCCACGT GTATTAAGCT
1351 GCTTGGTTGT GTGTGCCTTG GAGAATAATC AATAATATTA CATCTATGTT
1401 TAATTATAAA AAAAAAAAAA AAAAAAAAAA GTATCTGCGT TGTTACCACT
1451 GCTTAATCAC TAGTGAATTC
```

FIGURE 172

```
  1 MAPAKTLSYL SQQNTLESSF VREEDERPKV AYNNFSNEIP IISLAGIDEV
 51 DGRRTEICNK IVEACENWGI FQVVDHGVDT KLVSEMTRFA REFFALPPEE
101 KLRFDMSGGK KGGFIVSSHL QGEAVKDWRE LVTYFSYPIK QRDYSRWPDK
151 PEGWKEVTEK YSENLMNLAC KLLEVLSEAM GLEKEALTKA CVDMDQKVVI
201 NYYPKCPEPD LTLGLKRHTD PGTITLLLQD QVGGLQATKD NGKTWITVQP
251 VEGAFVVNLG DHGHYLSNGR FKNADHQAVV NSNYSRLSIA TFQNPAPDAT
301 VYPLKIRDGE KSVLEEPITF AEMYRRKMTK DLEIARMKKL AKEQQLRDLE
351 ENKTKYEAKP LNEIFA
```

FIGURE 173

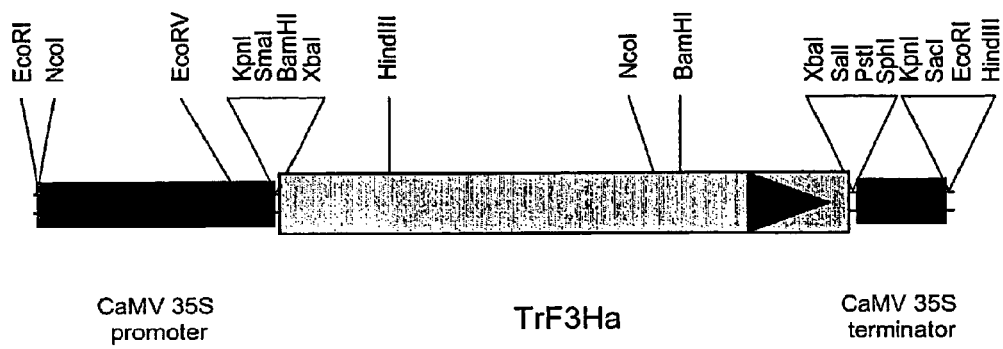
pDH51TrF3Ha sense
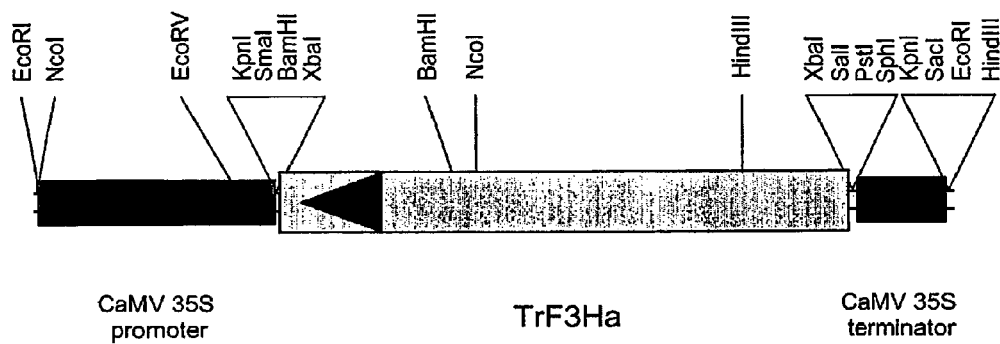
pDH51TrF3Ha anti
FIGURE 174

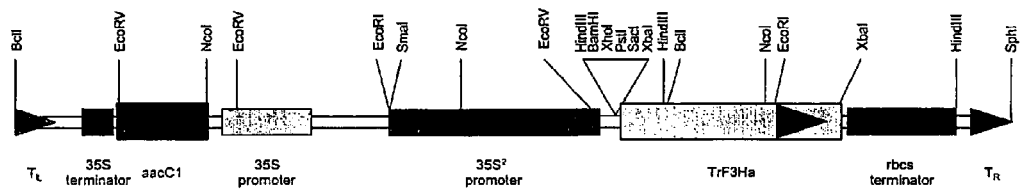
pPZP221:35S²TrF3Ha sense
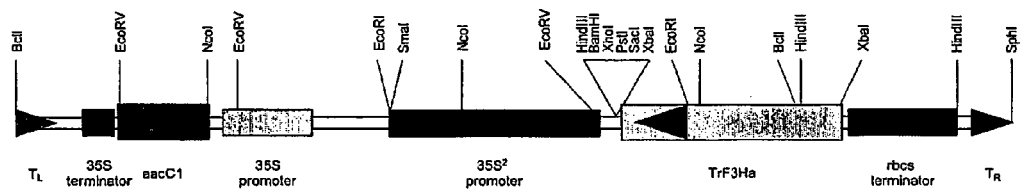
pPZP221:35S²TrF3Ha anti
FIGURE 175

```
   1 GAATTCGATT AAGCAGTGGT AACAACGCAG AGTACGCGGG GAGGAAATTC
  51 ACAACTCAAA TATTCCTTTA ATTCTTTCAT ATAATCATTT GAATTTCCAT
 101 TCTCCCTAAA AATTCTATAG CTACCACATC ACACAACATA ACAAATTAAG
 151 AAATATTTAT TACTATATTA AGATATGGAA GTAGTAGCAG CAGCAATCAC
 201 AAAAAACAAT GGCAAGATTG ATTCATTTTG CTTGAATCAT GCTAATGCTA
 251 ATAACATGAA AGTGAATGGT GCTGATCCTT TGAATTGGGG TGTGGCTGCT
 301 GAGGCAATGA AGGGAAGTCA CTTGGATGAG GTGAAGCGTA TGGTGGAGGA
 351 ATACCGGAAA CCGGTTGTCC GTCTTGGTGG CGAGACACTA ACCATTTCTC
 401 AGGTGGCTGC CATTGCTGCA CACGATGGTG CAACGGTGGA GCTATCGGAA
 451 TCTGCTAGAG CCGGCGTTAA GGCAAGCAGT GACTGGGTTA TGGAGAGTAT
 501 GAACAAAGGT ACCGACAGCT ACGGTGTCCC AACAGGGTTC GGCGCTACCT
 551 CGCACCGCCG AACCAAACAA GGTGGTGCTT TGCAGAAAGA GCTCATAAGG
 601 TTTTTGAATG CTGGAATATT TGGAAATGGA ACTGAGTCAA GCCACACACT
 651 ACCACACACA GCCACAAGAG CTGCCATGCT AGTGAGAATC AACACACTTC
 701 TCCAAGGCTA TTCAGGAATT AGATTTGAAA TCTTAGAAGC TATCACCAAG
 751 CTTCTTAACA ACAATGTCAC CCCATGTTTA CCGCTTCGCG GTACAATCAC
 801 AGCTTCAGGA GATTTAGTCC CTCTTTCTTA CATTGCTGGT TTACTAACCG
 851 GACGACCAAA TTCCAAGGCT CATGGACCTT CTGGAGAAGT ACTTAATGCA
 901 AAACAAGCTT TTCAATCAGC TGGAATCGAT GCCGAGTTCT TTGAATTACA
 951 ACCAAAAGAA GGCCTTGCCC TTGTTAACGG AACCGCTGTT GGTTCTGGTT
1001 TAGCTTCTAT TGTTCTTTTT GAGGCTAATA TATTGGCGGT GTTGTCTGAA
1051 GTTCTATCTG CAATTTTCGC TGAAGTTATG CAAGGGAAGC CCGAATTTAC
1101 CGATCATTTG ACACATAAGT TGAAACATCA CCCTGGTCAA ATTGAGGCTG
1151 CTGCTATTAT GGAACACATT TTGGATGGGA GTGCTTATGT TAAAGACGCT
1201 AAGAAGTTGC ATGAGATGGA TCCTTTACAG AAGCCAAAAC AAGATAGATA
1251 TGCACTTAGG ACTTCGCCAC AATGGCTTGG TCCTTTGATT GAAGTGATTA
1301 GATTCTCTAC CAAGTCAATT GAGAGAGAGA TCAACTCTGT CAATGACAAT
1351 CCTTTGATTG ATGTTTCAAG GAACAAGGCT TTGCATGGTG GAAATTTTCA
1401 AGGAACACCT ATCGGAGTAT CCATGGATAA TACACGTTTG GCTCTTGCAT
1451 CAATTGGCAA ACTTATGTTT GCTCAATTCT CTGAGCTTGT CAATGATTTT
1501 TACAACAATG GATTGCCATC AAATCTCTCT GCTAGTAGAA ATCCGAGCTT
1551 GGATTATGGG TTCAAGGGAT CCGAAATTGC CATGGCTTCT TATTGTTCCG
1601 AGTTGCAATA TCTTGCAAAT CCGGTTACAA CTCATGTCCA AGTGCGGAA
1651 CAACACAACC AAGATGTCAA CTCTTTGGGT TTGATTTCTT CTAGAAAAAC
1701 TTATGAAGCA ATTGAGATCC TTCAATTGAT GTCTTCCACA TTCTTGATTG
1751 CACTTTGTCA AGCAATTGAT TTAAGACATT TGGAGGAGAA TTTGAAAAAC
1801 TCGGTCAAAA ATACCGTAAG CCAAGTGGCC AAAAAGACAC TAACCATAGG
1851 TGTCAATGGA GAACTTCATC CTTCAAGATT TTGTGAAAAA GACTTATTGA
1901 AAGTGGTTGA TAGGGAACAT GTCTTTGCCT ACATTGATGA TCCTTGTAGT
1951 GCTACATACC CATTGATGCA AAAACTCAGG CAAGTACTAG TGGATCATGC
2001 ATTAGTTAAT GGAGAAAGTG AGAAGAATTT GAACACATCA ATCTTCCAAA
2051 AGATTGCAAC TTTTGAGGAA GAGTTGAAAA ACCTTTGCCA AAAGAGGTTG
2101 AAAGTGCAAG GATTGCATAT GAAAGTGGAA ATTCAACAAT TCCAAACAAG
2151 ATCAATGGAT GCAGATCTTA TCCACTCTAC AATTTTGTGA GAAAGGAGTT
2201 GGGAACTGGT TTGCTAACTG GAGAAAATGT CATTTCACCG GGTGAAGAGT
2251 GTGACAAACT ATTCACAGCT ATGTGTCAAG GAAAAATCAT TGATCCTCTT
2301 CTTGAATGCT TGGGAGAGTG GAACGGTGCT CCTCTTCCAA TTTGTTAACT
2351 TTGATTGTTA GTTCATAAAA TGTTTTATTT GTATTTATCA TTTGTATTTA
2401 TGCGAGTGTA GTAATAATGA TTAGGTGTTT TGTGCCTTTA ATGAAAAAAA
2451 AAAAAAAAAA AAAAAAAAAA AAAAGTACTC TGCGTTGTTA CCACTGCTTA
2501 ATCACTAGTG AATTC
```

FIGURE 177

```
  1  MEVVAAAITK  NNGKIDSFCL  NHANANNMKV  NGADPLNWGV  AAEAMKGSHL
 51  DEVKRMVEEY  RKPVVRLGGE  TLTISQVAAI  AAHDGATVEL  SESARAGVKA
101  SSDWVMESMN  KGTDSYGVPT  GFGATSHRRT  KQGGALQKEL  IRFLNAGIFG
151  NGTESSHTLP  HTATRAAMLV  RINTLLQGYS  GIRFEILEAI  TKLLNNNVTP
201  CLPLRGTITA  SGDLVPLSYI  AGLLTGRPNS  KAHGPSGEVL  NAKQAFQSAG
251  IDAEFFELQP  KEGLALVNGT  AVGSGLASIV  LFEANILAVL  SEVLSAIFAE
301  VMQGKPEFTD  HLTHKLKHHP  GQIEAAAIME  HILDGSAYVK  DAKKLHEMDP
351  LQKPKQDRYA  LRTSPQWLGP  LIEVIRFSTK  SIEREINSVN  DNPLIDVSRN
401  KALHGGNFQG  TPIGVSMDNT  RLALASIGKL  MFAQFSELVN  DFYNNGLPSN
451  LSASRNPSLD  YGFKGSEIAM  ASYCSELQYL  ANPVTTHVQS  AEQHNQDVNS
501  LGLISSRKTY  EAIEILQLMS  STFLIALCQA  IDLRHLEENL  KNSVKNTVSQ
551  VAKKTLTIGV  NGELHPSRFC  EKDLLKVVDR  EHVFAYIDDP  CSATYPLMQK
601  LRQVLVDHAL  VNGESEKNLN  TSIFQKIATF  EEELKNLCQK  RLKVQGLHMK
651  VEIQQFQTRS  MDADLIHSTI  L
```

FIGURE 178

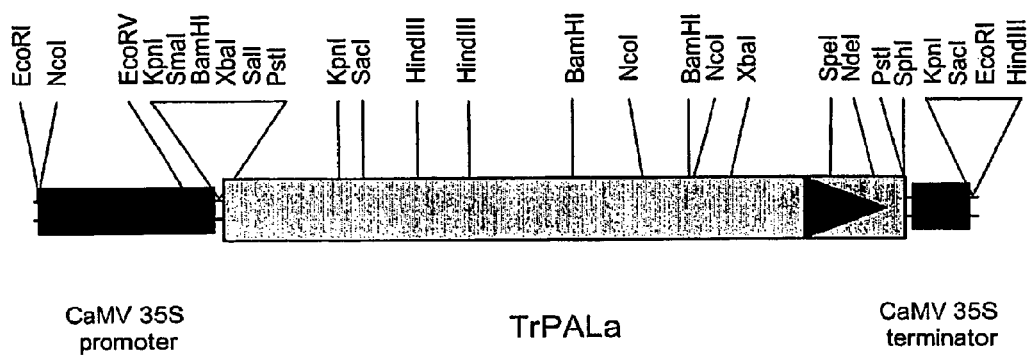
pDH51TrPALa sense
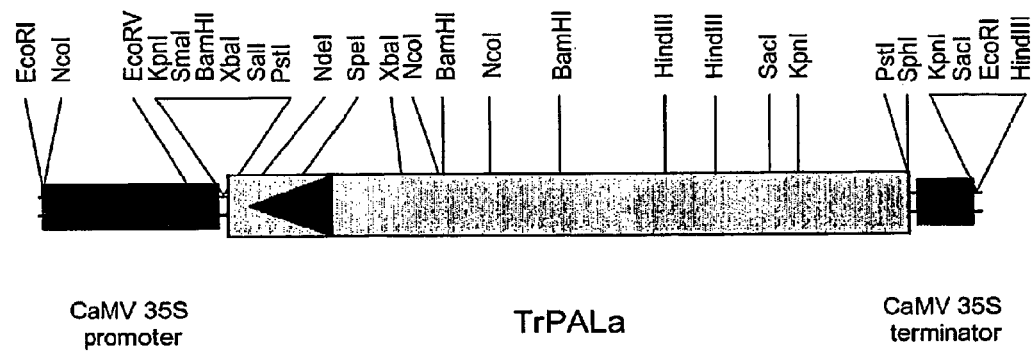
pDH51TrPALa anti
FIGURE 179

```
   1 GAATTCGATT AAGCAGTGGT AACAACGCAG AGTACGCGGG AGGAAATAAA
  51 TTCATCATTG TTCCTTATTT CCCACCCAAC ACAACATAAC AAATACATTT
 101 CCTCTCCTCT CATCACAATT ATTACTTTCT ACACCCCCCC CTCTCAACTA
 151 TTATTAACTA ACATAATGGA GGGAATTACC AATGGCCATG CTGAAGCAAC
 201 TTTTTGCGTG ACCAAAAGTG TTGGTGATCC ACTCAACTGG GGTGCAGCCG
 251 CGGAGTCGTT GATGGGGAGT CATTTGGATG AGGTGAAGCG TATGGTGGAG
 301 GAATACCGTA ATCCATTGGT TAAAATTGGC GGCGAGACGC TTACCATTGC
 351 TCAGGTGGCT GGAATTGCTT CTCATGATAG TGGTGTGAGG GTGGAGCTGT
 401 CTGAGTCCGC CAGGGCCGGC GTTAAGGCGA GTAGTGGTTG GGTGATGGAC
 451 AGCATGAACA ATGGGACTGA TAGTTATGGT GTTACCACTG GTTTCGGCGC
 501 CACCTCTCAC CGGAGAACCA AGCAGGGTGG TGCCTTGCAG AAGGAGCTAA
 551 TTAGGTTTTT GAATGCCGGA ATATTTGGCA ATGGTACAGA ATCTAACTGT
 601 ACACTACCAC ACACAGCAAC CAGAGCTGCA ATGCTTGTGA GAATCAACAC
 651 TCTTCTTCAA GGATATTCTG GAATTAGATT TGAAATTTTG GAAGCTATCA
 701 CAAAGCTTCT AAACAACAAC ATTACCCCAT GTTTACCACT TCGTGGTACA
 751 ATCACGGCTT CCGGTGATCT CGTTCCGCTT TCCTACATTG CCGGTTTGTT
 801 AACCGGTAGA CCGAACTCCA AAGCCGTTGG ACCCTCCGGA GAAATTCTCA
 851 ATGCAAAAGA AGCTTTTCAA CTTGCCGGCA TTGGTTCTGA GTTTTTTGAA
 901 TTGCAGCCAA AAGAAGGTCT TGCTCTTGTT AATGGTACTG CTGTTGGTTC
 951 TGGTTTAGCT TCTATTGTTC TGTTTGAAGC AAATGTACTA GCTGTTTTGT
1001 CTGAAGTTAT GTCGGCGATT TTCGCTGAAG TTATGCAAGG GAAACCAGAA
1051 TTCACTGATC ATTTGACTCA TAAGTTGAAA CATCACCCTG GTCAAATTGA
1101 AGCTGCTGCA ATTATGGAAC ATATTTTGGA TGGAAGTGCT TATGTTAAAG
1151 CAGCTAAGAA ATTACACGAA ACCGATCCTT TACAAAAGCC GAAACAAGAT
1201 CGTTATGCAC TTAGAACTTC ACCTCAATGG CTTGGTCCTT TGATTGAAGT
1251 GATAAGATTT TCAACTAAGT CAATTGAGAG AGAAATTAAC TCTGTCAATG
1301 ATAACCCTTT GATTGATGTT TCAAGGAACA AGGCCATTCA CGGTGGTAAT
1351 TTTCAAGGAA CACCTATTGG AGTTTCAATG GATAACACAC GTTTAGCTCT
1401 TGCTTCAATT GGTAAACTCA TGTTTGCTCA ATTCTCTGAA CTTGTTAATG
1451 ATTTTTACAA CAACGGGTTA CCTTCGAATC TTACTGCTAG TAGGAACCCA
1501 AGCTTGGATT ACGGTTTCAA GGGATCGGAA ATTGCCATGG CTTCTTATTG
1551 TTCTGAGTTA CAATATCTTG CTAATCCTGT CACCACCCAT GTCCAAAGTG
1601 CGGAGCAACA CAATCAAGAT GTTAACTCTT TGGGTTTGAT TTCTTCAAGA
1651 AAAACAAATG AAGCTATTGA GATCCTAAAG CTCATGTCTT CGACATTTCT
1701 GATTGCACTT TGTCAAGCAA TTGATTTAAG GCATTTGGAG GAAAATCTGA
1751 GGAACACTGT CAAGAACACG GTAAGCCAAG TAGCGAAGAG AACACTCACC
1801 ACCGGTGTTA ATGGAGAACT TCATCCTTCT AGATTTTGTG AGAAAGATTT
1851 GCTCAAAGTT GTTGATAGGG AGTATGTATT TGCCTATGTC GACGATCCTT
1901 GTCTAGCTAC ATACCCTTTG ATGCAAAAGT TGAGACAAGT GCTTGTGGAT
1951 CATGCATTGG TAAATGCTGA TGGAGAGAAG AATTTGAACA CATCAATCTT
2001 TCAAAAGATT GCAACTTTTG AGGATGAATT GAAAGCTATC TTGCCAAAGG
2051 AAGTTGAAAG TACAAGAACT GCATATGAAA ATGGACAATG TGGAATTTCA
2101 AACAAGATTA AGGAATGCAG GTCTTATCCA TTGTACAAGT TTGTTAGAGA
2151 GGAGTTAGGA ACCGCGTTGC TAACCGGAGA AAAAACGATA TCGCTGGGCG
2201 AAGAGTGTGA CAAATTGTTC ACAGCTATGT GCCAAGGTAA AATTGTTGAT
2251 CCTCTTTTGG AATGCCTTGG AGAGTGGAAT GGTGCTCCTC TACCAATATG
2301 TTAATTAGCA GAATTAATAT GTTTCTTTGA GAAGTGATTT CTTTATATAT
2351 TTGTAGTATA CTATAGTAGT TGCATTGAGA AGCAATTGGT TTGTCTATAA
2401 GCCTATGGAA AATGGCAAAA CAATTTTCTG CTCAAAGCAT CGTTTATTAA
2451 GTTTTCCTTA AAGTGTTAAG GAACTTTTAA TTGTTTTTGT AATAGAATTT
2501 CATTTGTTTG CCACAACTTT GGGTGCAAAT ATCACGTGAT ACATGTGGTG
2551 TTTGATGTAA ATGGTGTTTT CTCAATTAAT AAATAGTGTT TCAGCCATGA
2601 AAAAAAAAAA AAAAAAAAAA AAAAAGTAC TCTGCGTTGT TACCACTGCT
2651 TAATCACTAG TGAATTC
```

FIGURE 182

```
  1 MEGITNGHAE ATFCVTKSVG DPLNWGAAAE SLMGSHLDEV KRMVEEYRNP
 51 LVKIGGETLT IAQVAGIASH DSGVRVELSE SARAGVKASS GWVMDSMNNG
101 TDSYGVTTGF GATSHRRTKQ GGALQKELIR FLNAGIFGNG TESNCTLPHT
151 ATRAAMLVRI NTLLQGYSGI RFEILEAITK LLNNNITPCL PLRGTITASG
201 DLVPLSYIAG LLTGRPNSKA VGPSGEILNA KEAFQLAGIG SEFFELQPKE
251 GLALVNGTAV GSGLASIVLF EANVLAVLSE VMSAIFAEVM QGKPEFTDHL
301 THKLKHHPGQ IEAAAIMEHI LDGSAYVKAA KKLHETDPLQ KPKQDRYALR
351 TSPQWLGPLI EVIRFSTKSI EREINSVNDN PLIDVSRNKA IHGGNFQGTP
401 IGVSMDNTRL ALASIGKLMF AQFSELVNDF YNNGLPSNLT ASRNPSLDYG
451 FKGSEIAMAS YCSELQYLAN PVTTHVQSAE QHNQDVNSLG LISSRKTNEA
501 IEILKLMSST FLIALCQAID LRHLEENLRN TVKNTVSQVA KRTLTTGVNG
551 ELHPSRFCEK DLLKVVDREY VFAYVDDPCL ATYPLMQKLR QVLVDHALVN
601 ADGEKNLNTS IFQKIATFED ELKAILPKEV ESTRTAYENG QCGISNKIKE
651 CRSYPLYKFV REELGTALLT GEKTISLGEE CDKLFTAMCQ GKIVDPLLEC
701 LGEWNGAPLP IC
```

FIGURE 183

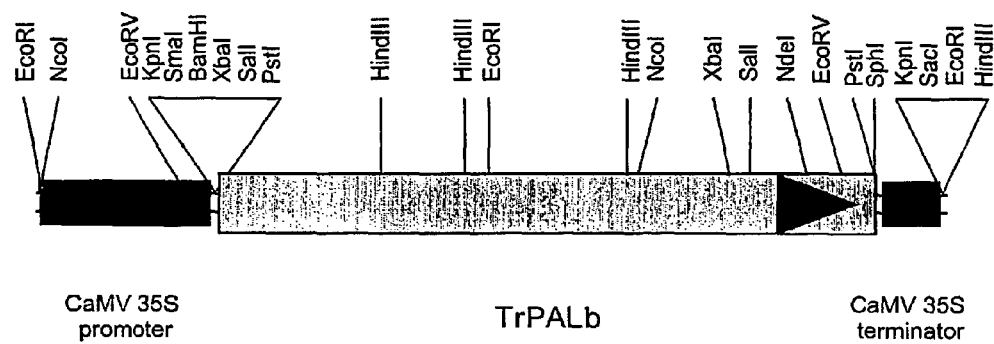
pDH51TrPALb sense
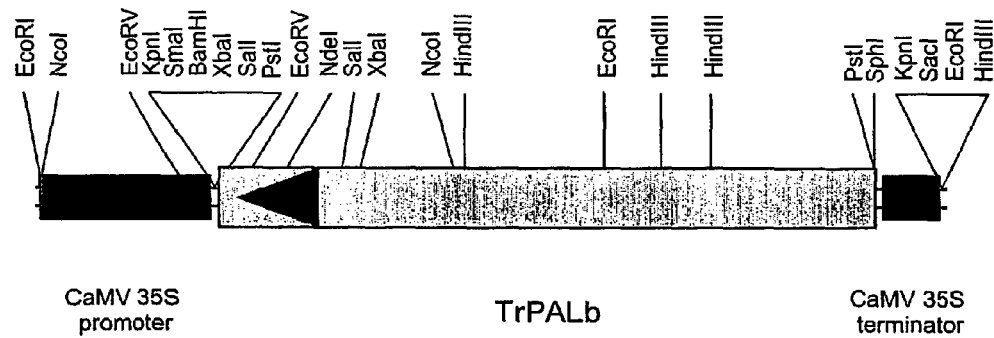
pDH51TrPALb anti
FIGURE 184

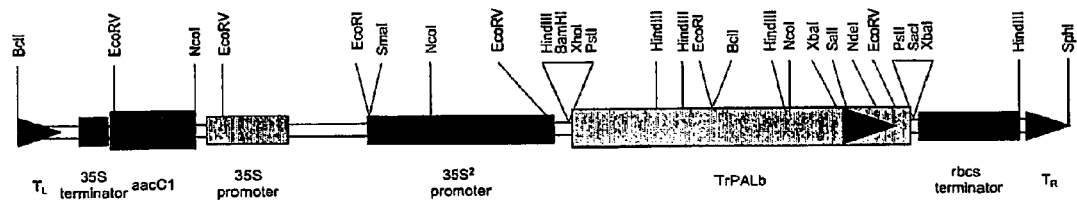
pPZP221:35S²TrPALb sense
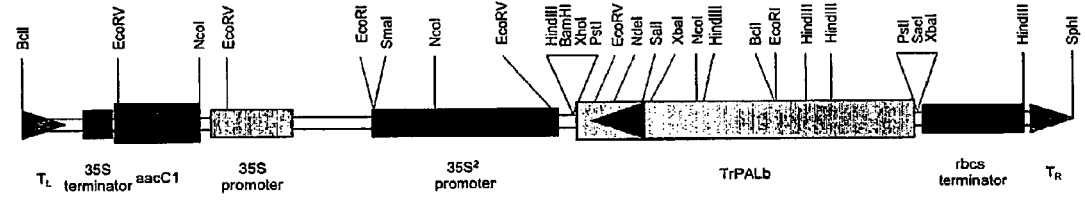
pPZP221:35S²TrPALb anti
FIGURE 185

```
   1 GAATTCACTA GTGATTAAGC AGTGGTAACA ACGCAGAGTA CGCGGGGAGG
  51 AAATAAATTC ATCATTGTTC ATTATTTCCC ACCCAACACA ACATAACAAA
 101 TACATTATTC TCTCCTCTGA TCACAATTAT TACTTTCTAC ACCCTCCTCT
 151 CAACTATTAT TAACTAGCAT AATGGAGGGA ATTACCAATG GCCATGCTGA
 201 AACAACTTTT TGCGTGACCA AAAGTGTTGG TGATCCACTC AACTGGGGTG
 251 CAGCCGCGGA GTCGTTGACG GGGAGTCATT TGGATGAGGT GAAGCGTATG
 301 GTGGAGGAGT ACCGTAATCC GTTGGCTAAA ATTGGCGGCG AGACGCTTAC
 351 CATTGCTCAG GTGGCTGGAA TTGCTTCTCA TGATAGTGGT GTGAGGGTGG
 401 AGCTGTCCGA GTCCGCAAGG GCCGGCGTTA AGGCGAGTAG TGATTGGGTG
 451 ATGGATAGCA TGAACAATGG GACTGATAGT TACGGTGTTA CCACCGGTTT
 501 TGGTGCCACC TCTCACCGGA GAACCAAGCA GGGTGGTGCT TTGCAGAAGG
 551 AGCTAATTAG GTTTTTGAAT GCTGGAATAT TTGGCAATGG TACAGAATCT
 601 AACTGTACAC TACCACACAC AGCAACTAGA GCTGCAATGC TTGTGAGAAT
 651 CAACACTCTT CTTCAAGGGT ACTCTGGTAT TAGATTTGAA ATTTTGGAAG
 701 CTATCACAAA GCTTCCAAAC AACAACATTA CCCCATGTTT ACCACTTCGT
 751 GGTACAATCA CGGCTTCCGG TGATCTTGTT CCGCTTTCCT ACATTGCCGG
 801 TTTGTTAACC GGAAGACCCA ACTCCAAAGC AGTTGGACCT TCCGGAGAAA
 851 TTTTGAGTGC TAAAGAAGCT TTTCAACTCG CCGGCATTGG TTCTGAGTTT
 901 TTTGAATTGC AACCAAAAGA AGGTCTTGCT CTTGTTAATG GTACTGCTGT
 951 TGGCTCTGGT TTAGCTTCTA TTGTTCTGTT TGAAGCAAAT GTACTAGCTG
1001 TTTTATCCGA AGTTATGTCG GCGATTTTCG CTGAAGTTAT GCAAGGGAAA
1051 CCGGAATTTA CCGATCATTT GACTCATAAG TTGAAACATC ACCCTGGTCA
1101 AATTGAAGCT GCTGCAATTA TGGAACATAT TTTGGATGGA AGTGCTTATG
1151 TTAAAGCAGC TAAGAAGTTA CACGAAACCG ATCCTTTACA AAAACCGAAA
1201 CAAGATCGTT ATGCACTTAG AACTTCACCT CAATGGCTTG GTCCTTTGAT
1251 TGAAGTGATA AGATTTTCAA CCAAATCGAT TGAAAGAGAA ATTAACTCGG
1301 TCAACGACAA CCCTTTGATC GATGTTTCAA GGAACAAGGC CATTCATGGT
1351 GGTAACTTTC AAGGAACACC TATTGGAGTT TCAATGGATA ACACACGTTT
1401 AGCTCTTGCT TCAATTGGTA AACTCATGTT TGCTCAATTC TCTGAACTTG
1451 TTAATGATTT TTACAACAAC GGGTTGCCTT CGTATCTTAC TGCTAGTAGG
1501 AACCCGAGCT TGGACTATGG TTTCAAGGGA TCGGAAATTG CCATGGCTTC
1551 GTATTGTTCC GAGTTACAAT ATCTTGCTAA TCCTGTCACC ACCCATGTCC
1601 AAAGTGCCGA GCAACACAAC CAAGATGTTA ACTCTTTGGG TTTGATTTCT
1651 TCTAGAAAAA CAAATGAAGC TATTGAGATT CTCAAGCTCA TGTCTTCCAC
1701 TTTCTTGATT GCATTATGTC AAGCAATCGA CTTAAGGCAC TTGGAGGAAA
1751 ATCTCAGGAA CACCGTCAAG AACACGGTAA GCCAAGTAGC GAAGAGAACA
1801 CTCACCACCG GCGTCAACGG AGAACTTCAT TCTTCTAGAT TTTGTGAGAA
1851 AGATTTGCTT AAAGTTGTTG ATAGGGAGTA TGTATTTGCC TATGCCGACG
1901 ATCCTTGTCT AGCTACATAC CCTTTGATGC AAAAGTTGAG ACAAGTGCTT
1951 GTGGATCATG CATTGGTAAA TGTTGATGGA GAGAAGAATT TGAACACATC
2001 AATCTTTCAA AAGATTGCAA CTTTTGAGGA TGAGTTGAAA GCTATTTTGC
2051 CAAAGGAGGT TGAAAGTACA AGAACTGCAT ATGAAAATGG ACAATGTGGA
2101 ATTTCAAACA AGATTAAGGA ATGCAGGTCT TATCCATTGT ACAAGTTTGT
2151 TAGAGAGGAG TTAGGAACCG CGTTGCTAAC CGGAGAAAAA ACTATATCGC
2201 CGGGCGAAGA GTGCGATAAA TTGTTCACAG CTATGTGCCA AGGTAAAATT
2251 GTTGATCCTC TTATGGAATG CCTCGGAGAG TGGAATGGTG CTCCTCTACC
2301 AATATGTTAA TTAGCATAAT ATGTTTTCTT TGAGAAGTGA TTACTTTATA
2351 TATTTGTAGT ATACTATAGT AGTTGCATTG AGAAGAAATT GGTTTGTTTA
2401 TAAGCCTATG GAAAATGGCA AATCAATTTT CTGCTCAAAG CATCGTTTAT
2451 TAAGTTTTCC TTAAAGTGTT AAGGAACTTT TAATTGTTTT TGTAATAGAA
2501 TTTCATTTGT TTGCCACAAC TTTGGGTGCA AATATCACAT GATACATGTG
2551 GTGTTTGATG TAAATGGTGT TTTTTCAATA AATAAATAGT GTTTCAACTA
2601 AAAAAAAAAA AAAAAAAAAA AAAAAAAAAG TACTCTGCGT TGTTACCACT
2651 GCTTAATCGA ATTC
```

FIGURE 187

```
  1  MEGITNGHAE  TTFCVTKSVG  DPLNWGAAAE  SLTGSHLDEV  KRMVEEYRNP
 51  LAKIGGETLT  IAQVAGIASH  DSGVRVELSE  SARAGVKASS  DWVMDSMNNG
101  TDSYGVTTGF  GATSHRRTKQ  GGALQKELIR  FLNAGIFGNG  TESNCTLPHT
151  ATRAAMLVRI  NTLLQGYSGI  RFEILEAITK  LPNNNITPCL  PLRGTITASG
201  DLVPLSYIAG  LLTGRPNSKA  VGPSGEILSA  KEAFQLAGIG  SEFFELQPKE
251  GLALVNGTAV  GSGLASIVLF  EANVLAVLSE  VMSAIFAEVM  QGKPEFTDHL
301  THKLKHHPGQ  IEAAAIMEHI  LDGSAYVKAA  KKLHETDPLQ  KPKQDRYALR
351  TSPQWLGPLI  EVIRFSTKSI  EREINSVNDN  PLIDVSRNKA  IHGGNFQGTP
401  IGVSMDNTRL  ALASIGKLMF  AQFSELVNDF  YNNGLPSYLT  ASRNPSLDYG
451  FKGSEIAMAS  YCSELQYLAN  PVTTHVQSAE  QHNQDVNSLG  LISSRKTNEA
501  IEILKLMSST  FLIALCQAID  LRHLEENLRN  TVKNTVSQVA  KRTLTTGVNG
551  ELHSSRFCEK  DLLKVVDREY  VFAYADDPCL  ATYPLMQKLR  QVLVDHALVN
601  VDGEKNLNTS  IFQKIATFED  ELKAILPKEV  ESTRTAYENG  QCGISNKIKE
651  CRSYPLYKFV  REELGTALLT  GEKTISPGEE  CDKLFTAMCQ  GKIVDPLMEC
701  LGEWNGAPLP  IC
```

FIGURE 188

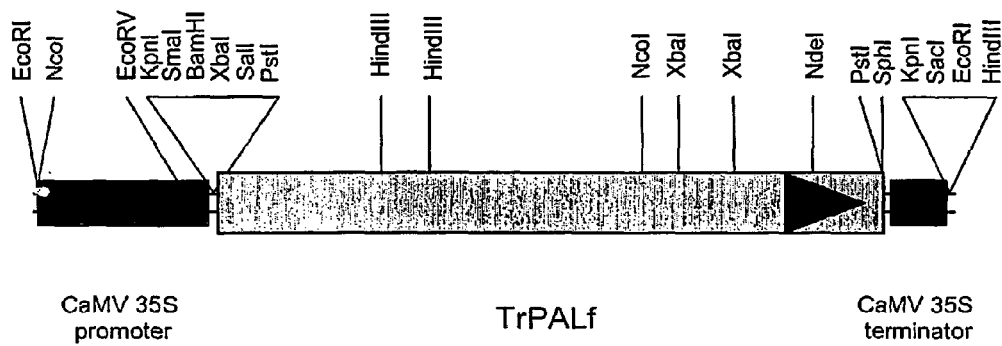
pDH51TrPALf sense
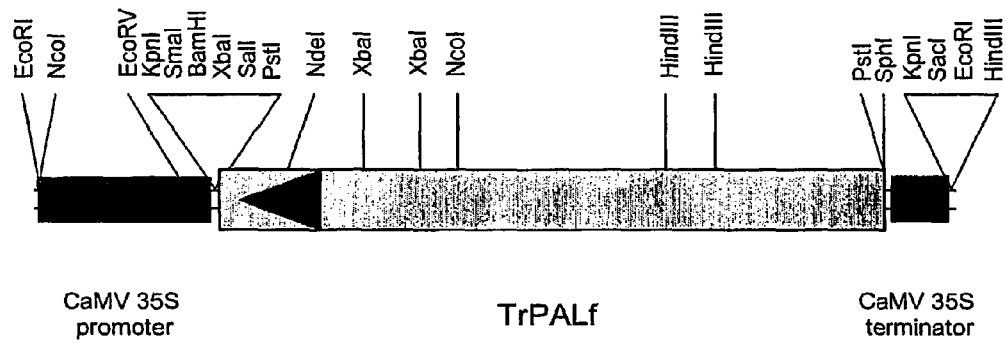
pDH51TrPALf anti
FIGURE 189

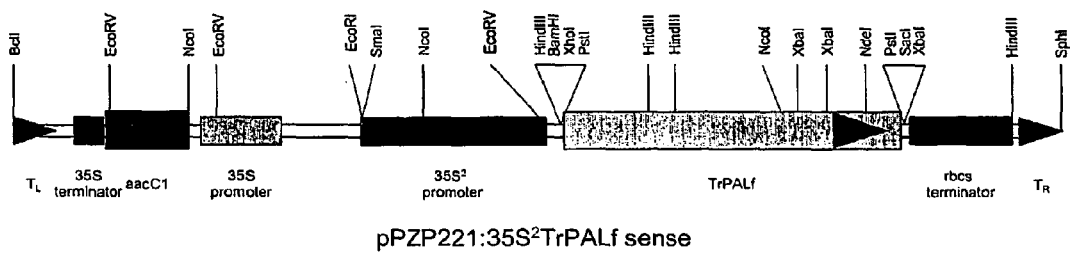
pPZP221:35S²TrPALf sense
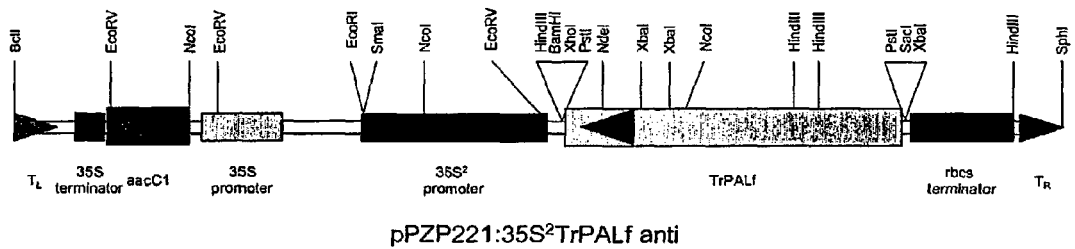
pPZP221:35S²TrPALf anti
FIGURE 190

```
   1 GAATTCGATT AAGCAGTGGT AACAACGCAG AGTACGCGGG ATAGTAGTAG
  51 TTGAGAAAAA ATACACAAAT AAAGTAAACA CTATCATAGA AAGAGAGTCA
 101 AAAATGGCTG AAGGAAAAGG AAGGGTTTGT GTTACTGGAG GAACAGGTTT
 151 TCTTGGTTCA TGGATCATCA AGAGTCTTCT TGAAAATGGA TACTCTGTTA
 201 ATACCACTAT TAGAGCTGAT CCAGAACGTA AGAGGGATGT AAGCTTCCTA
 251 ACAAATCTAC CCGGCGCATC CGAAAGGCTA CATTTCTTCA ACGCCGATCT
 301 AGACGACCCA GAGAGTTTCA ACGAAGCAAT TGAAGGTTGT GTCGGGATAT
 351 TCCACACCGC TTCACCAATC GATTTCGCCG TGAGTGAGCC AGAAGAAATA
 401 GTGACAAAAA GAACAGTGGA TGGAGCATTA GGAATTTTAA AAGCATGTGT
 451 GAATTCAAAG ACAGTGAAGA GATTTATTTA CACTTCAAGT GGTTCTGCTG
 501 TTTCATTCAA TGGAAAAAAC AAAGATGTTT TGGATGAGAG TGATTGGAGT
 551 GATGTTGATT TGCTTAGAAG TGTTAAACCA TTTGGTTGGA GTTATGGTGT
 601 TTCAAAGACT TTGGCTGAGA AAGCAGTGCT TGAATTTGGT CAACAAAATG
 651 GGATTGATGT TGTTACTTTG ATTCTTCCTT TTATTGTTGG AAGTTTTGTT
 701 TGTCCTAAGC TTCCTGATTC TGTTGAGAAA GCTCTTGTTT TGGTACTAGG
 751 CAAAAAGGAA CAAATTGGTA TTATAAGTTT CCACATGGTA CATGTGGATG
 801 ATGTGGCTAG AGCACATATT TATCTACTTG AGAATCCTGT TCCAGGAGGT
 851 AGATATAATT GTTCACCATT CTTTGTATCT ATTGAAGAAA TGTCACAACT
 901 TCTTTCAGCC AAATATCCAG AATATCAAAT ACTATCAGTA GATGAGTTGA
 951 AGGAAATCAA AGGTGCAAGG TTGCCAGATT TGAACTCGAA AAAGCTCGTG
1001 GACGCTGGTT TTGAGTTTAA GTATAGTGTC GGTGATATGT TCGATGATGC
1051 GATTCAATGC TGCAAGGAAA AAGGCTATCT CTAAGTATGT GTTTGAAAAA
1101 AATTCCATGA AGCTGAGAAA ACAATAATAT GCCTAAAATC AATGATGGCT
1151 AATGAAATGT ACAAGTTTAT GCATAAAGTT ATTTGTGATG AATCAAATAA
1201 TGAAATAATC GGTTCATTTT TCCGAAAAAA AAAAAAAAAA AAAAAAAAA
1251 AAAAAGTACT CTGCGTTGTT ACCACTGCTT AATCACTAGT GAATTC
```

FIGURE 192

```
  1  MAEGKGRVCV TGGTGFLGSW IIKSLLENGY SVNTTIRADP ERKRDVSFLT
 51  NLPGASERLH FFNADLDDPE SFNEAIEGCV GIFHTASPID FAVSEPEEIV
101  TKRTVDGALG ILKACVNSKT VKRFIYTSSG SAVSFNGKNK DVLDESDWSD
151  VDLLRSVKPF GWSYGVSKTL AEKAVLEFGQ QNGIDVVTLI LPFIVGSFVC
201  PKLPDSVEKA LVLVLGKKEQ IGIISFHMVH VDDVARAHIY LLENPVPGGR
251  YNCSPFFVSI EEMSQLLSAK YPEYQILSVD ELKEIKGARL PDLNSKKLVD
301  AGFEFKYSVG DMFDDAIQCC KEKGYL
```

FIGURE 193

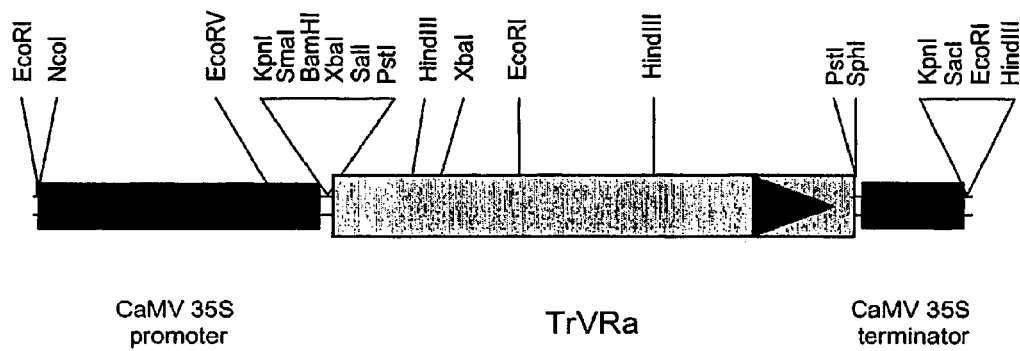
pDH51TrVRa sense
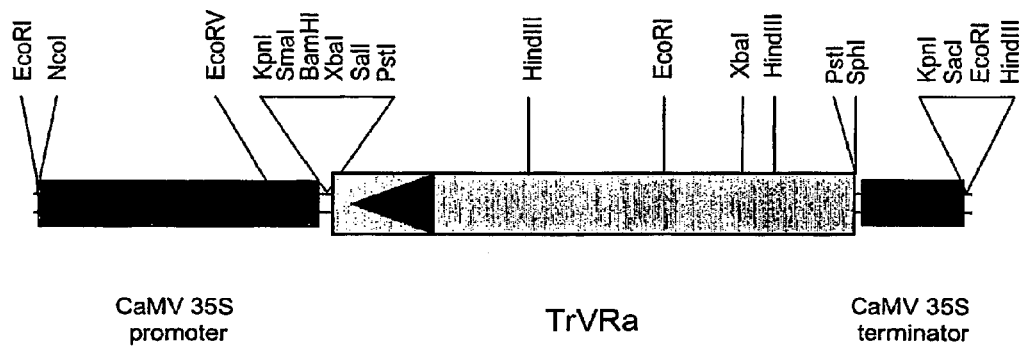
pDH51TrVRa anti
FIGURE 194

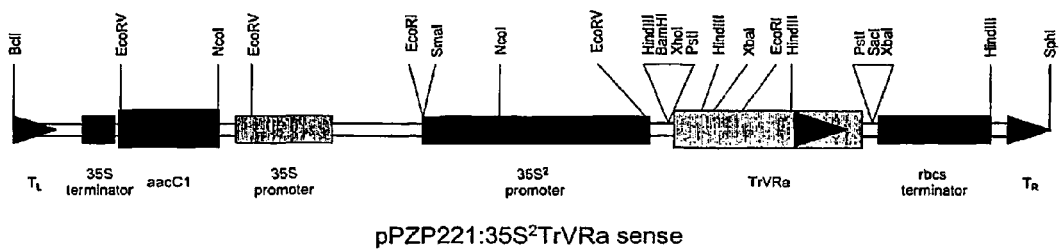
pPZP221:35S²TrVRa sense
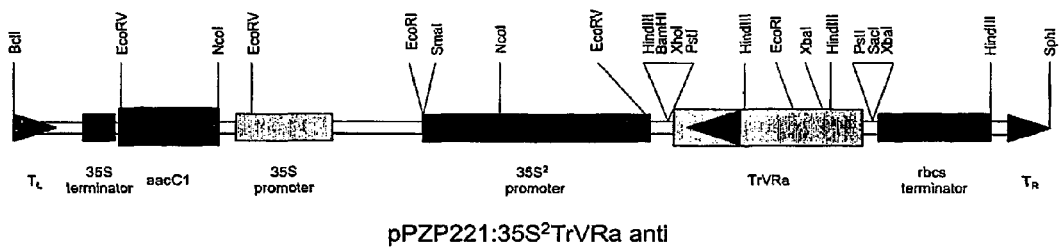
pPZP221:35S²TrVRa anti
FIGURE 195

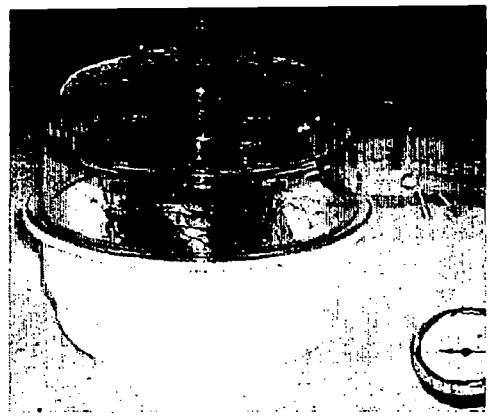
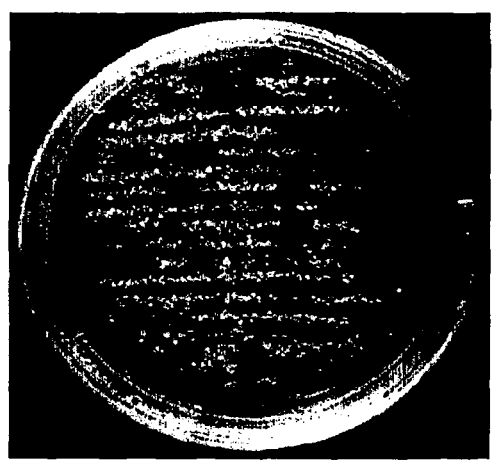
FIGURE 196

D
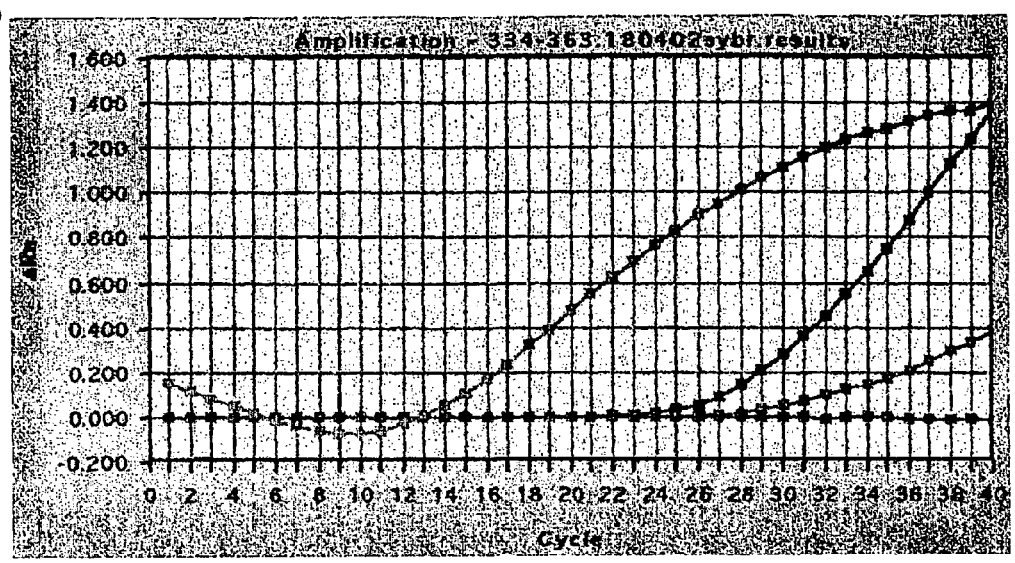
E
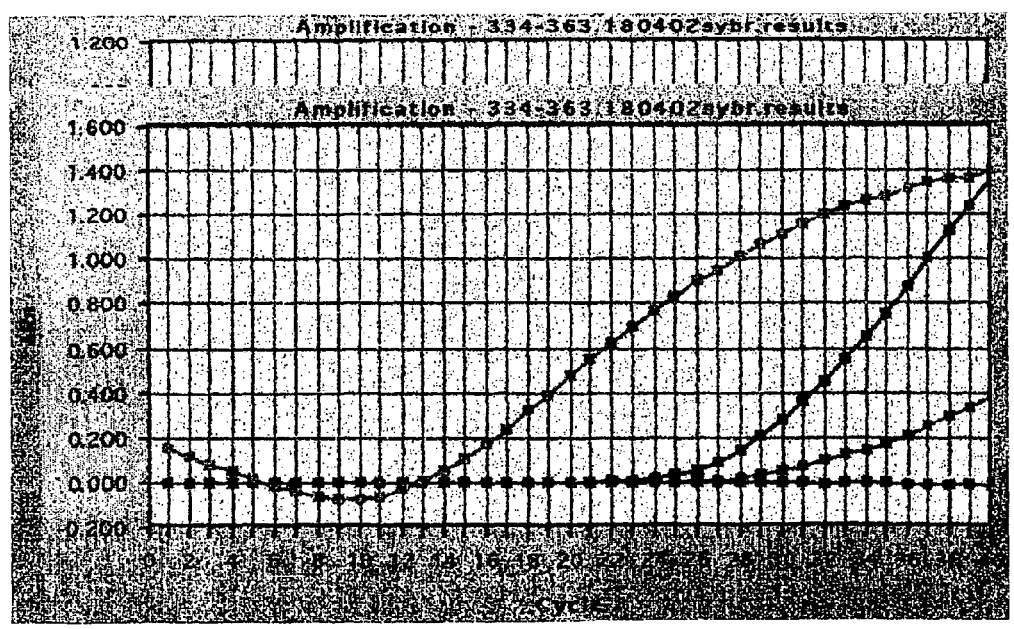
FIGURE 196 (cont)

MANIPULATION OF FLAVONOID BIOSYNTHESIS IN PLANTS

CROSS REFERENCE TO RELATED APPLICATIONS

This application claims the benefit of International patent application PCT/AU2002/001345, filed Oct. 4, 2002, which claims the benefit of Australian patent application PR8113, filed Oct. 5, 2001.

The present invention relates to nucleic acids and nucleic acid fragments encoding amino acid sequences for flavonoid biosynthetic enzymes in plants, and the use thereof for the modification of flavonoid biosynthesis in plants.

BACKGROUND OF THE INVENTION

Flavonoids constitute a relatively diverse family of aromatic molecules that are derived from phenylalanine and malonyl-coenzyme A (CoA, via the fatty acid pathway). These compounds include six major subgroups that are found in most higher plants: the chalcones, flavones, flavonols, flavandiols, anthocyanins and condensed tannins (or proanthocyanidins). A seventh group, the aurones, is widespread, but not ubiquitous.

Some plant species also synthesize specialized forms of flavonoids, such as the isoflavonoids that are found in legumes and a small number of non-legume plants. Similarly, sorghum, maize and gloxinia are among the few species known to synthesize 3-deoxyanthocyanins (or phlobaphenes in the polymerised form). The stilbenes which are closely related to flavonoids, are synthesised by another group of unrelated species that includes grape, peanut and pine.

Besides providing pigmentation to flowers, fruits, seeds, and leaves, flavonoids also have key roles in signaling between plants and microbes, in male fertility of some species, in defense as antimicrobial agents and feeding deterrents, and in UV protection. Flavonoids also have significant activities when ingested by animals, and there is great interest in their potential health benefits, particularly for compounds such as isoflavonoids, which have been linked to anticancer benefits, and stilbenes that are believed to contribute to reduced heart disease.

The major branch pathways of flavonoid biosynthesis start with general phenylpropanoid metabolism and lead to the nine major subgroups: the colorless chalcones, aurones, isoflavonoids, flavones, flavonols, flavandiols, anthocyanins, condensed tannins, and phlobaphene pigments. The enzyme phenylalanine ammonia-lyase (PAL) of the general phenylpropanoid pathway will lead to the production of cinnamic acid. Cinnamate-4-hydroxylase (C4H) will produce p-coumaric acid which will be converted through the action of 4-coumaroyl:CoA-ligase (4CL) to the production of 4-coumaroyl-CoA and malonyl-CoA. The first committed step in flavonoid biosynthesis is catalyzed by chalcone synthase (CHS), which uses malonyl CoA and 4-coumaryl CoA as substrates. Chalcone reductase (CHR) balances the production of 5-hydroxy- or 5-deoxyflavonoids. The next enzyme, chalcone isomerase (CHI) catalyses ring closure to faun a flavanone, but the reaction can also occur spontaneously. Other enzymes in the pathway are: flavanone 3-hydroxylase (F3H), dihydroflavonol 4-reductase (DFR), flavonoid 3'-hydroxylase (F3'H) and flavonoid 3',5' hydroxylase (F3'5'H).

The *Arabidopsis* BANYULS gene encodes a DFR-like protein that may be a leucoanthocyanidin reductase (LCR) that catalyzes an early step in condensed tannin biosynthesis.

Condensed tannins are plant polyphenols with protein-precipitating and antioxidant properties, synthesized by the flavonoid pathway. Their chemical properties include protein binding, metal chelation, anti-oxidation, and UV-light absorption. As a result condensed tannins inhibit viruses, micro-organisms, insects, fungal pathogens, and monogastric digestion. Moderate amounts of tannins improve forage quality by disrupting protein foam and conferring protection from rumen pasture bloat. Bloat is a digestive disorder that occurs on some highly nutritious forage legumes such as alfalfa (*Medicago sativa*) and white clover (*Trifolium repens*). Moderate amounts of tannin can also reduce digestion rates in the rumen and can reduce parasitic load sufficiently to increase the titre of amino acids and small peptides in the small intestine without compromising total digestion.

Vestitone reductase (VR) is the penultimate enzyme in medicarpin biosynthesis. Medicarpin, a phytoalexin, has been associated with plant resistance to fungal pathogens.

While nucleic acid sequences encoding some flavonoid biosynthetic enzymes CHI, CHS, CHR, DFR, LCR, F3'5'H, F3H, F3'H, PAL and VR have been isolated for certain species of plants, there remains a need for materials useful in modifying flavonoid biosynthesis; in modifying protein binding, metal chelation, anti-oxidation, and UV-light absorption; in modifying plant pigment production; in modifying plant defense to biotic stresses such as viruses, micro-organisms, insects or fungal pathogens; in modifying forage quality, for example by disrupting protein foam and/or conferring protection from rumen pasture bloat, particularly in forage legumes and grasses, including alfalfa, medics, clovers, ryegrasses and fescues, and for methods for their use.

It is an object of the present invention to overcome, or at least alleviate, one or more of the difficulties or deficiencies associated with the prior art.

SUMMARY OF THE INVENTION

In one aspect of the present invention, substantially purified or isolated nucleic acids or nucleic acid fragments encoding amino acid sequences for a class of proteins which are related to CHI, CHS, CHR, DFR, LCR, F3'5'H, F3H, F3'H, PAL and VR and functionally active fragments and variants thereof. Such proteins are referred to herein as CHI-like, CHS-like, CHR-like, DFR-like, LCR-like, F3'5'H-like, F3H-like, F3'H-like, PAL-like and VR-like, respectively.

The individual or simultaneous enhancement or otherwise manipulation of CHI, CHS, CHR, DFR, LCR, F3'5'H, F3H, F3'H, PAL and/or VR or like gene activities in plants may enhance or otherwise alter flavonoid biosynthesis; may enhance or otherwise alter the plant capacity for protein binding, metal chelation, anti-oxidation or UV-light absorption; may enhance or reduce or otherwise alter plant pigment production; may modify plant defense to biotic stresses such as viruses, micro-organisms, insects or fungal pathogens; and/or may modify forage quality, for example by disrupting protein foam and/or conferring protection from rumen pasture bloat.

In one aspect of the present invention, substantially purified or isolated nucleic acids or fragments thereof, encoding the flavonoids biosynthetic enzymes CHI, CHS, CHR, DFR, LCR, F3'5'H, F3H, F3'H, PAL and VR from a clover (Trifolium), medic (Medicago), ryegrass (Lolium) or fescue (Festuca) species and functionally active fragments and variants thereof.

The individual or simultaneous enhancement or otherwise manipulation of CHI, CHS, CHR, DFR, LCR, F3'5'H, F3H, F3'H, PAL and/or VR or like gene activities in plants has significant consequences for a range of applications in, for example, plant production and plant protection. For example, it has applications in increasing plant tolerance and plant defense to biotic stresses such as viruses, micro-organisms, insects and fungal pathogens; in improving plant forage quality, for example by disrupting protein foam and in conferring protection from rumen pasture bloat; in reducing digestion rates in the rumen and reducing parasitic load; in the production of plant compounds leading to health benefits, such as isoflavonoids, which have been linked to anticancer benefits, and stilbenes that are believed to contribute to reduced heart disease.

Methods for the manipulation of CHI, CHS, CHR, DFR, LCR, F3'5'H, F3H, F3'H, PAL and/or VR or like gene activities in plants, including legumes such as clovers (*Trifolium species*), lucerne (*Medicago sativa*) and grass species such as ryegrasses (*Lolium* species) and fescues (*Festuca* species) may facilitate the production of, for example, forage legumes and forage grasses and other crops with enhanced tolerance to biotic stresses such as viruses, micro-organisms, insects and fungal pathogens; altered pigmentation in flowers; forage legumes with enhanced herbage quality and bloat-safety; crops with enhanced isoflavonoid content leading to health benefits.

The clover (*Trifolium*), medic (*Medicago*), ryegrass (*Lolium*) or fescue (*Festuca*) species may be of any suitable type, including white clover (*Trifolium repens*), red clover (*Trifolium pratense*), subterranean clover (*Trifolium subterraneum*), alfalfa (*Medicago sativa*), Italian or annual ryegrass (*Lolium multiflorum*), perennial ryegrass (*Lolium perenne*), tall fescue (*Festuca arundinacea*), meadow fescue (*Festuca pratensis*) and red fescue (*Festuca rubra*). Preferably the species is a clover or a ryegrass, more preferably white clover (*T. repens*) or perennial ryegrass (*L. perenne*). White clover (*Trifolium repens* L.) and perennial ryegrass (*Lolium perenne* L.) are key pasture legumes and grasses, respectively, in temperate climates throughout the world. Perennial ryegrass is also an important turf grass.

The nucleic acid or nucleic acid fragment may be of any suitable type and includes DNA (such as cDNA or genomic DNA) and RNA (such as mRNA) that is single- or double-stranded, optionally containing synthetic, non-natural or altered nucleotide bases, and combinations thereof.

The term "isolated" means that the material is removed from its original environment (eg. the natural environment if it is naturally occurring). For example, a naturally occurring nucleic acid present in a living plant is not isolated, but the same nucleic acid separated from some or all of the coexisting materials in the natural system, is isolated. Such nucleic acids could be part of a vector and/or such nucleic acids could be part of a composition, and still be isolated in that such a vector or composition is not part of its natural environment.

Such nucleic acids or nucleic acid fragments could be assembled to form a consensus contig. As used herein, the term "consensus contig" refers to a nucleotide sequence that is assembled from two or more constituent nucleotide sequences that share common or overlapping regions of sequence homology. For example, the nucleotide sequence of two or more nucleic acids or nucleic acid fragments can be compared and aligned in order to identify common or overlapping sequences. Where common or overlapping sequences exist between two or more nucleic acids or nucleic acid fragments, the sequences (and thus their corresponding nucleic acids or nucleic acid fragments) can be assembled into a single contiguous nucleotide sequence.

In a preferred embodiment of this aspect of the invention, the substantially purified or isolated nucleic acid or nucleic acid fragment encoding a CHI or CHI-like protein includes a nucleotide sequence selected from the group consisting of (a) sequences shown in FIGS. 1, 3, 4, 6, 7, 9, 10, 12, 122 and 127 hereto (SEQ ID NOs: 1, 3 to 7, 8, 10 to 12, 13, 15 and 16, 17, 19 to 22, 307, and 309, respectively); (b) complements of the sequences recited in (a); (c) sequences antisense to the sequences recited in (a) and (b); and (d) functionally active fragments and variants of the sequences recited in (a), (b) and (c).

In a further preferred embodiment of this aspect of the invention, the substantially purified or isolated nucleic acid or nucleic acid fragment encoding a CHS or CHS-like protein includes a nucleotide sequence selected from the group consisting of (a) sequences shown in FIGS. 13, 15, 16, 18, 19, 21, 22, 24, 25, 27, 28, 30, 31, 33, 34, 137, 142, 147, 152, 157 and 162 hereto (SEQ ID NOs: 23, 25 to 63, 64, 66 to 68, 69, 71 to 77, 78, 80 to 90, 91, 93 and 94, 95, 97 to 100, 101, 103 to 105, 106, 313, 315, 317, 319, 321, and 323, respectively); (b) complements of the sequences recited in (a); (c) sequences antisense to the sequences recited in (a) and (b); and (d) functionally active fragments and variants of the sequences recited in (a), (b) and (c).

In a further preferred embodiment of this aspect of the invention, the substantially purified or isolated nucleic acid or nucleic acid fragment encoding a CHR or CHR-like protein includes a nucleotide sequence selected from the group consisting of (a) sequences shown in FIGS. 36, 38, 40, 41, 43 and 132 hereto (SEQ ID NOs: 108, 110, 112 to 116, 117, 119 to 134, and 311, respectively); (b) complements of the sequences recited in (a); (c) sequences antisense to the sequences recited in (a) and (b); and (d) functionally active fragments and variants of the sequences recited in (a), (b) and (c).

In a further preferred embodiment of this aspect of the invention, the substantially purified or isolated nucleic acid or nucleic acid fragment encoding a DFR or DFR-like protein includes a nucleotide sequence selected from the group consisting of (a) sequences shown in FIGS. 44, 46, 47, 49, 50, 52, 54, 55, 57, 59, 61, 62, 64, 101, 103, 104, 106, 117 and 167 hereto (SEQ ID NOs: 135, 137 to 146, 147, 149 to 152, 153, 155, 157 and 158, 159, 161, 163, 165 to 167, 168, 170 to 184, 286, 288 to 292, 293, 295 to 297, 305, and 325, respectively); (b) complements of the sequences recited in (a); (c) sequences antisense to the sequences recited in (a) and (b); and (d) functionally active fragments and variants of the sequences recited in (a), (b) and (c).

In a further preferred embodiment of this aspect of the invention, the substantially purified or isolated nucleic acid or nucleic acid fragment encoding an LCR or LCR-like protein includes a nucleotide sequence selected from the group consisting of (a) sequences shown in FIGS. 65 and 67 hereto (SEQ ID NOs: 185 and 187 to 193, respectively); (b) complements of the sequences recited in (a); (c) sequences antisense to the sequences recited in (a) and (b); and (d) functionally active fragments and variants of the sequences recited in (a), (b) and (c).

In a still further preferred embodiment of this aspect of the invention, the substantially purified or isolated nucleic acid or nucleic acid fragment encoding an F3'5'H or F3'5'H-like protein includes a nucleotide sequence selected from the group consisting of (a) sequences shown in FIGS. 68, 70 and 72 hereto (SEQ ID NOs: 194, 196, and 198 to 201, respectively); (b) complements of the sequences recited in (a); (c) sequences antisense to the sequences recited in (a) and (b); and (d) functionally active fragments and variants of the sequences recited in (a), (b) and (c).

In a further preferred embodiment of this aspect of the invention, the substantially purified or isolated nucleic acid or nucleic acid fragment encoding an F3H or F3H-like protein includes a nucleotide sequence selected from the group consisting of (a) sequences shown in FIGS. 73, 75, 76, 78, 107, 109, 111 and 172 hereto (SEQ ID NOs: 202, 204 to 244, 245, 247, 298, 300 to 302, 303, and 327, respectively); (b) complements of the sequences recited in (a); (c) sequences antisense to the sequences recited in (a) and (b); and (d) functionally active fragments and variants of the sequences recited in (a), (b) and (c).

In a still further preferred embodiment of this aspect of the invention, the substantially purified or isolated nucleic acid or nucleic acid fragment encoding an F3'H or F3'H-like protein includes a nucleotide sequence selected from the group consisting of (a) sequences shown in FIGS. 80 and 82 hereto (SEQ ID NOs: 249, and 251 and 252, respectively); (b) complements of the sequences recited in (a); (c) sequences antisense to the sequences recited in (a) and (b); and (d) functionally active fragments and variants of the sequences recited in (a), (b) and (c).

In a further preferred embodiment of this aspect of the invention, the substantially purified or isolated nucleic acid or nucleic acid fragment encoding an PAL or PAL-like protein includes a nucleotide sequence selected from the group consisting of (a) sequences shown in FIGS. 83, 85, 86, 88, 89, 91, 93, 95, 97, 177, 182 and 187 hereto (SEQ ID NOs: 253, 255 to 257, 258, 260 to 267, 268, 270, 272, 274, 276 and 277, 329, 331, and 333, respectively); (b) complements of the sequences recited in (a); (c) sequences antisense to the sequences recited in (a) and (b); and (d) functionally active fragments and variants of the sequences recited in (a), (b) and (c).

In a still further preferred embodiment of this aspect of the invention, the substantially purified or isolated nucleic acid or nucleic acid fragment encoding an VR or VR-like protein includes a nucleotide sequence selected from the group consisting of (a) sequences shown in FIGS. 98, 100 and 192 hereto (SEQ ID NOs: 278, 280 to 285, and 335, respectively); (b) complements of the sequences recited in (a); (c) sequences antisense to the sequences recited in (a) and (b); and (d) functionally active fragments and variants of the sequences recited in (a), (b) and (c).

By "functionally active" in relation to nucleic acids it is meant that the fragment or variant (such as an analogue, derivative or mutant) encodes a polypeptide which is capable of modifying flavonoid biosynthesis in a plant. Such variants include naturally occurring allelic variants and non-naturally occurring variants. Additions, deletions, substitutions and derivatizations of one or more of the nucleotides are contemplated so long as the modifications do not result in loss of functional activity of the fragment or variant. Preferably the functionally active fragment or variant has at least approximately 80% identity to the relevant part of the above mentioned nucleotide sequence, more preferably at least approximately 90% identity, even more preferably at least approximately 95% identity, most preferably at least approximately 98% homology. Such functionally active variants and fragments include, for example, those having nucleic acid changes which result in conservative amino acid substitutions of one or more residues in the corresponding amino acid sequence. Preferably the fragment has a size of at least 10 nucleotides, more preferably at least 15 nucleotides, most preferably at least 20 nucleotides.

Nucleic acids or nucleic acid fragments encoding at least a portion of several CHI, CHS, CHR, DFR, LCR, F3'5'H, F3H, F3'H, PAL and VR have been isolated and identified. The nucleic acids or nucleic acid fragments of the present invention may be used to isolate cDNAs and genes encoding homologous proteins from the same or other plant species. Isolation of homologous genes using sequence-dependent protocols, such as methods of nucleic acid hybridisation, and methods of DNA and RNA amplification as exemplified by various uses of nucleic acid amplification technologies (e.g. polymerase chain reaction, ligase chain reaction), is well known in the art.

For example, genes encoding other CHI or CHI-like, CHS or CHS-like, CHR or CHR-like, DFR or DFR-like, LCR or LCR-like, F3'5'H or F3'5'H-like, F3H or F3H-like, F3'H or F3'H-like, PAL or PAL-like and VR or VR-like proteins, either as cDNAs or genomic DNAs, may be isolated directly by using all or a portion of the nucleic acids or nucleic acid fragments of the present invention as hybridisation probes to screen libraries from the desired plant employing the methodology well known to those skilled in the art. Specific oligonucleotide probes based upon the nucleic acid sequences of the present invention may be designed and synthesized by methods known in the art. Moreover, the entire sequences may be used directly to synthesize DNA probes by methods known to the skilled artisan such as random primer DNA labelling, nick translation, or end-labelling techniques, or RNA probes using available in vitro transcription systems. In addition, specific primers may be designed and used to amplify a part or all of the sequences of the present invention. The resulting amplification products may be labelled directly during amplification reactions or labelled after amplification reactions, and used as probes to isolate full-length cDNA or genomic fragments under conditions of appropriate stringency.

In addition, short segments of the nucleic acids or nucleic acid fragments of the present invention may be used in amplification protocols to amplify longer nucleic acids or nucleic acid fragments encoding homologous genes from DNA or RNA. For example, polymerase chain reaction may be performed on a library of cloned nucleic acid fragments wherein the sequence of one primer is derived from the nucleic acid sequences of the present invention, and the sequence of the other primer takes advantage of the presence of the polyadenylic acid tracts to the 3' end of the mRNA precursor encoding plant genes. Alternatively, the second primer sequence may be based upon sequences derived from the cloning vector. For example, those skilled in the art can follow the RACE protocol [Frohman et al. (1988) Proc. Natl. Acad Sci. USA 85:8998, the entire disclosure of which is incorporated herein by reference] to generate cDNAs by using PCR to amplify copies of the region between a single point in the transcript and the 3' or 5' end. Using commercially available 3' RACE and 5' RACE systems (BRL), specific 3' or 5' cDNA fragments may be isolated [Ohara et al. (1989) Proc. Natl. Acad Sci USA 86:5673; Loh et al. (1989) Science 243:217, the entire disclosures of which are incorporated herein by reference]. Products generated by the 3' and 5' RACE procedures may be combined to generate full-length cDNAs.

In a second aspect of the present invention there is provided a substantially purified or isolated polypeptide from a clover (*Trifolium*), medic (*Medicago*), ryegrass (*Lolium*) or fescue (*Festuca*) species, selected from the group consisting of CHI and CHI-like, CHS and CHS-like, CHR and CHR-like, DFR and DFR-like, LCR and LCR-like, F3'5'H and F3'5'H-like, F3H and F3H-like, F3'H and F3'H-like, PAL and PAL-like, VR and VR-like; and functionally active fragments and variants thereof.

The clover (*Trifolium*), medic (*Medicago*), ryegrass (*Lolium*) or fescue (*Festuca*) species may be of any suitable type, including white clover (*Trifolium repens*), red clover (*Trifolium pratense*), subterranean clover (*Trifolium subterra*- neum), alfalfa (*Medicago sativa*), Italian or annual ryegrass (*Lolium multiflorum*), perennial ryegrass (*Lolium perenne*), tall fescue (*Festuca arundinacea*), meadow fescue (*Festuca pratensis*) and red fescue (*Festuca rubra*). Preferably the species is a clover or a ryegrass, more preferably white clover (*T. repens*) or perennial ryegrass (*L. perenne*).

In a preferred embodiment of this aspect of the invention, the substantially purified or isolated CHI or CHI-like polypeptide includes an amino acid sequence selected from the group consisting of the sequences shown in FIGS. 2, 5, 8, 11, 123 and 128 hereto (SEQ ID NOs: 2, 9, 14, 18, 308, and 310, respectively), and functionally active fragments and variants thereof.

In a further preferred embodiment of this aspect of the invention, the substantially purified or isolated CHS or CHS-like polypeptide includes an amino acid sequence selected from the group consisting of the sequences shown in FIGS. 14, 17, 20, 23, 26, 29, 32, 35, 138, 143, 148, 153, 158 and 163 hereto (SEQ ID NOs: 24, 65, 70, 79, 92, 96, 102, 107, 314, 316, 318, 320, 322, and 324, respectively), and functionally active fragments and variants thereof.

In a further preferred embodiment of this aspect of the invention, the substantially purified or isolated CHR or CHR-like polypeptide includes an amino acid sequence selected from the group consisting of the sequences shown in FIGS. 37, 39, 42 and 133 hereto (SEQ ID NOs: 109, 111, 118, and 312, respectively), and functionally active fragments and variants thereof.

In a still further preferred embodiment of this aspect of the invention, the substantially purified or isolated DFR or DFR-like polypeptide includes an amino acid sequence selected from the group consisting of the sequences shown in FIGS. 45, 48, 51, 53, 56, 58, 60, 63, 102, 105, 118 and 168 hereto (SEQ ID NOs: 136, 148, 54, 156, 160, 162, 164, 169, 287, 294, 306, and 326, respectively), and functionally active fragments and variants thereof.

In a still further preferred embodiment of this aspect of the invention, the substantially purified or isolated LCR or LCR-like polypeptide includes an amino acid sequence shown in FIG. 66 hereto (SEQ ID NO: 186), and functionally active fragments and variants thereof.

In a still further preferred embodiment of this aspect of the invention, the substantially purified or isolated F3'5'H or F3'5'H-like polypeptide includes an amino acid sequence selected from the group consisting of the sequences shown in FIGS. 69 and 71 hereto (SEQ ID NOs: 195 and 197, respectively), and functionally active fragments and variants thereof.

In a still further preferred embodiment of this aspect of the invention, the substantially purified or isolated F3H or F3H-like polypeptide includes an amino acid sequence selected from the group consisting of the sequences shown in FIGS. 74, 77, 79, 108, 112 and 173 hereto (SEQ ID NOs: 203, 246, 248, 299, 304, and 328, respectively), and functionally active fragments and variants thereof.

In a still further preferred embodiment of this aspect of the invention, the substantially purified or isolated F3'H or F3'H-like polypeptide includes an amino acid sequence shown in FIG. 81 hereto (SEQ ID NO: 250), and functionally active fragments and variants thereof.

In a still further preferred embodiment of this aspect of the invention, the substantially purified or isolated PAL or PAL-like polypeptide includes an amino acid sequence selected from the group consisting of the sequences shown in FIGS. 84, 87, 90, 92, 94, 96, 178, 183 and 188 hereto (SEQ ID NOs: 254, 259, 269, 271, 273, 275, 330, 332, and 334, respectively), and functionally active fragments and variants thereof.

In a still further preferred embodiment of this aspect of the invention, the substantially purified or isolated VR or VR-like polypeptide includes an amino acid sequence shown in FIGS. 99 and 193 hereto (SEQ ID NOs: 279 and 336, respectively), and functionally active fragments and variants thereof.

By "functionally active" in relation to polypeptides it is meant that the fragment or variant has one or more of the biological properties of the proteins CHI, CHI-like, CHS, CHS-like, CHR, CHR-like, DFR, DFR-like, LCR, LCR-like, F3'5'H, F3'5'H-like, F3H, F3H-like, F3'H, F3'H-like, PAL, PAL-like, VR and VR-like, respectively. Additions, deletions, substitutions and derivatizations of one or more of the amino acids are contemplated so long as the modifications do not result in loss of functional activity of the fragment or variant. Preferably the functionally active fragment or variant has at least approximately 60% identity to the relevant part of the above mentioned amino acid sequence, more preferably at least approximately 80% identity, even more preferably at least approximately 90% identity most preferably at least approximately 95% homology. Such functionally active variants and fragments include, for example, those having conservative amino acid substitutions of one or more of residues in the corresponding amino acid sequence. Preferably the fragment has a size of at least 10 amino acids, more preferably at least 15 amino acids, most preferably at least 20 amino acids.

In a further embodiment of this aspect of the invention, there is provided a polypeptide recombinantly produced from a nucleic acid or nucleic acid fragment according to the present invention. Techniques for recombinantly producing polypeptides are well known to those skilled in the art.

Availability of the nucleotide sequences of the present invention and deduced amino acid sequences facilitates immunological screening of cDNA expression libraries. Synthetic peptides representing portions of the instant amino acid sequences may be synthesized. These peptides may be used to immunise animals to produce polyclonal or monoclonal antibodies with specificity for peptides and/or proteins including the amino acid sequences. These antibodies may be then used to screen cDNA expression libraries to isolate full-length cDNA clones of interest.

A genotype is the genetic constitution of an individual or group. Variations in genotype are important in commercial breeding programs, in determining parentage, in diagnostics and fingerprinting, and the like. Genotypes can be readily described in terms of genetic markers. A genetic marker identifies a specific region or locus in the genome. The more genetic markers, the finer defined is the genotype. A genetic marker becomes particularly useful when it is allelic between organisms because it then may serve to unambiguously identify an individual. Furthermore, a genetic marker becomes particularly useful when it is based on nucleic acid sequence information that can unambiguously establish a genotype of an individual and when the function encoded by such nucleic acid is known and is associated with a specific trait. Such nucleic acids and/or nucleotide sequence information including single nucleotide polymorphisms (SNPs), variations in single nucleotides between allelic forms of such nucleotide sequence, may be used as perfect markers or candidate genes for the given trait.

Applicants have identified a number of SNPs of the nucleic acids or nucleic acid fragments of the present invention. These are indicated (marked with grey on the black background) in the figures that show multiple alignments of nucleotide sequences of nucleic acid fragments contributing to consensus contig sequences. See for example, FIGS. 3, 6, 9, 12, 15, 18, 21, 24, 27, 30, 33, 40, 43, 46, 49, 54, 61, 64, 67, 72, 75, 82, 85, 88, 97, 100, 103, 106 and 109 hereto (SEQ ID NOs: 3 to 7, 10 to 12, 15 and 16, 19 to 22, 25 to 63, 66 to 68, 71 to 77, 80 to 90, 93 and 94, 97 to 100, 103 to 105, 112 to 116, 119 to 134, 137 to 146, 149 to 152, 157 and 158, 165 to 167, 170 to 184, 187 to 193, 198 to 201, 204 to 244, 251 and 252, 255 to 257, 260 to 267, 276 and 277, 280 to 285, 288 to 292, 295 to 297, and 300 to 302, respectively).

Accordingly, in a further aspect of the present invention, there is provided a substantially purified or isolated nucleic acid or nucleic acid fragment including a single nucleotide polymorphism (SNP) from a nucleic acid or nucleic acid fragment according to the present invention or complements or sequences antisense thereto, and functionally active fragments and variants thereof.

In a still further aspect of the present invention there is provided a method of isolating a nucleic acid or nucleic acid fragment of the present invention including a SNP, said method including sequencing nucleic acid fragments from a nucleic acid library.

The nucleic acid library may be of any suitable type and is preferably a cDNA library.

The nucleic acid or nucleic acid fragments may be isolated from a recombinant plasmid or may be amplified, for example using polymerase chain reaction.

The sequencing may be performed by techniques known to those skilled in the art.

In a still further aspect of the present invention, there is provided use of the nucleic acids or nucleic acid fragments of the present invention including SNPs, and/or nucleotide sequence information thereof, as molecular genetic markers.

In a still further aspect of the present invention there is provided use of a nucleic acid or nucleic acid fragment of the present invention, and/or nucleotide sequence information thereof, as a molecular genetic marker.

More particularly, nucleic acids or nucleic acid fragments according to the present invention and/or nucleotide sequence information thereof may be used as a molecular genetic marker for quantitative trait loci (QTL) tagging, QTL mapping, DNA fingerprinting and in marker assisted selection, particularly in clovers, alfalfa, ryegrasses and fescues. Even more particularly, nucleic acids or nucleic acid fragments according to the present invention and/or nucleotide sequence information thereof may be used as molecular genetic markers in plant improvement in relation to plant tolerance to biotic stresses such as viruses, micro-organisms, insects, fungal pathogens; in relation to forage quality; in relation to bloat safety; in relation to condensed tannin content; in relation to plant pigmentation. Even more particularly, sequence information revealing SNPs in allelic variants of the nucleic acids or nucleic acid fragments of the present invention and/or nucleotide sequence information thereof may be used as molecular genetic markers for QTL tagging and mapping and in marker assisted selection, particularly in clovers, alfalfa, ryegrasses and fescues.

In a still further aspect of the present invention there is provided a construct including a nucleic acid or nucleic acid fragment according to the present invention.

The term "construct" as used herein refers to an artificially assembled or isolated nucleic acid molecule which includes the gene of interest. In general a construct may include the gene or genes of interest, a marker gene which in some cases can also be the gene of interest and appropriate regulatory sequences. It should be appreciated that the inclusion of regulatory sequences in a construct is optional, for example, such sequences may not be required in situations where the regulatory sequences of a host cell are to be used. The term construct includes vectors but should not be seen as being limited thereto.

In a still further aspect of the present invention there is provided a vector including a nucleic acid or nucleic acid fragment according to the present invention.

The term "vector" as used herein encompasses both cloning and expression vectors. Vectors are often recombinant molecules containing nucleic acid molecules from several sources.

In a preferred embodiment of this aspect of the invention, the vector may include a regulatory element such as a promoter, a nucleic acid or nucleic acid fragment according to the present invention and a terminator; said regulatory element, nucleic acid or nucleic acid fragment and terminator being operatively linked.

By "operatively linked" is meant that said regulatory element is capable of causing expression of said nucleic acid or nucleic acid fragment in a plant cell and said terminator is capable of terminating expression of said nucleic acid or nucleic acid fragment in a plant cell. Preferably, said regulatory element is upstream of said nucleic acid or nucleic acid fragment and said terminator is downstream of said nucleic acid or nucleic acid fragment.

The vector may be of any suitable type and may be viral or non-viral. The vector may be an expression vector. Such vectors include chromosomal, non-chromosomal and synthetic nucleic acid sequences, e.g. derivatives of plant viruses; bacterial plasmids; derivatives of the Ti plasmid from *Agrobacterium tumefaciens*, derivatives of the Ri plasmid from *Agrobacterium rhizogenes*; phage DNA; yeast artificial chromosomes; bacterial artificial chromosomes; binary bacterial artificial chromosomes; vectors derived from combinations of plasmids and phage DNA. However, any other vector may be used as long as it is replicable, integrative or viable in the plant cell.

The regulatory element and terminator may be of any suitable type and may be endogenous to the target plant cell or may be exogenous, provided that they are functional in the target plant cell.

Preferably the regulatory element is a promoter. A variety of promoters which may be employed in the vectors of the present invention are well known to those skilled in the art. Factors influencing the choice of promoter include the desired tissue specificity of the vector, and whether constitutive or inducible expression is desired and the nature of the plant cell to be transformed (e.g. monocotyledon or dicotyledon). Particularly suitable constitutive promoters include the Cauliflower Mosaic Virus 35S (CaMV 35S) promoter and derivatives thereof, the maize Ubiquitin promoter, and the rice Actin promoter.

A variety of terminators which may be employed in the vectors of the present invention are also well known to those skilled in the art. The terminator may be from the same gene as the promoter sequence or a different gene. Particularly suitable terminators are polyadenylation signals, such as the CaMV 35S polyA and other terminators from the nopaline synthase (nos), the octopine synthase (ocs) and the rbcS genes.

The vector, in addition to the regulatory element, the nucleic acid or nucleic acid fragment of the present invention and the terminator, may include further elements necessary for expression of the nucleic acid or nucleic acid fragment, in different combinations, for example vector backbone, origin of replication (ori), multiple cloning sites, spacer sequences, enhancers, introns (such as the maize Ubiquitin Ubi intron), antibiotic resistance genes and other selectable marker genes

[such as the neomycin phosphotransferase (npt2) gene, the hygromycin phosphotransferase (hph) gene, the phosphinothricin acetyltransferase (bar or pat) gene and the gentamycin acetyl transferase (aacC1) gene], and reporter genes [such as beta-glucuronidase (GUS) gene (gusA) and green fluorescent protein (gfp)]. The vector may also contain a ribosome binding site for translation initiation. The vector may also include appropriate sequences for amplifying expression.

As an alternative to use of a selectable marker gene to provide a phenotypic trait for selection of transformed host cells, the presence of the vector in transformed cells may be determined by other techniques well known in the art, such as PCR (polymerase chain reaction), Southern blot hybridisation analysis, histochemical GUS assays, northern and Western blot hybridisation analyses.

Those skilled in the art will appreciate that the various components of the vector are operatively linked, so as to result in expression of said nucleic acid or nucleic acid fragment. Techniques for operatively linking the components of the vector of the present invention are well known to those skilled in the art. Such techniques include the use of linkers, such as synthetic linkers, for example including one or more restriction enzyme sites.

The constructs and vectors of the present invention may be incorporated into a variety of plants, including monocotyledons (such as grasses from the genera *Lolium, Festuca, Paspalum, Pennisetum, Panicum* and other forage and turf-grasses, corn, oat, sugarcane, wheat and barley), dicotyledons (such as *Arabidopsis*, tobacco, clovers, medics, eucalyptus, potato, sugarbeet, canola, soybean, chickpea) and gymnosperms. In a preferred embodiment, the constructs and vectors may be used to transform monocotyledons, preferably grass species such as ryegrasses (*Lolium* species) and fescues (*Festuca* species), more preferably perennial ryegrass, including forage- and turf-type cultivars. In an alternate preferred embodiment, the constructs and vectors may be used to transform dicotyledons, preferably forage legume species such as clovers (*Trifolium* species) and medics (*Medicago* species), more preferably white clover (*Trifolium repens*), red clover (*Trifolium pratense*), subterranean clover (*Trifolium subterraneum*) and alfalfa (*Medicago sativa*). Clovers, alfalfa and medics are key pasture legumes in temperate climates throughout the world.

Techniques for incorporating the constructs and vectors of the present invention into plant cells (for example by transduction, transfection or transformation) are well known to those skilled in the art. Such techniques include *Agrobacterium* mediated introduction, electroporation to tissues, cells and protoplasts, protoplast fusion, injection into reproductive organs, injection into immature embryos and high velocity projectile introduction to cells, tissues, calli, immature and mature embryos. The choice of technique will depend largely, on the type of plant to be transformed.

Cells incorporating the constructs and vectors of the present invention may be selected, as described above, and then cultured in an appropriate medium to regenerate transformed plants, using techniques well known in the art. The culture conditions, such as temperature, pH and the like, will be apparent to the person skilled in the art. The resulting plants may be reproduced, either sexually or asexually, using methods well known in the art, to produce successive generations of transformed plants.

In a further aspect of the present invention there is provided a plant cell, plant, plant seed or other plant part, including, e.g. transformed with, a construct, vector, nucleic acid or nucleic acid fragment of the present invention.

The plant cell, plant, plant seed or other plant part may be from any suitable species, including monocotyledons, dicotyledons and gymnosperms. In a preferred embodiment the plant cell, plant, plant seed or other plant part may be from a monocotyledon, preferably a grass species, more preferably a ryegrass (*Lolium* species) or fescue (*Festuca* species), even more preferably perennial ryegrass, including both forage- and turf-type cultivars. In an alternate preferred embodiment the plant cell, plant, plant seed or other plant part may be from a dicotyledon, preferably forage legume species such as clovers (*Trifolium* species) and medics (*Medicago* species), more preferably white clover (*Trifolium repens*), red clover (*Trifolium pratense*), subterranean clover (*Trifolium subterraneum*) and alfalfa (*Medicago sativa*).

The present invention also provides a plant, plant seed or other plant part, or a plant extract derived from a plant cell of the present invention.

The present invention also provides a plant, plant seed or other plant part, or a plant extract derived from a plant of the present invention.

In a further aspect of the present invention there is provided a method of modifying flavonoid biosynthesis in a plant; said method including introducing into said plant an effective amount of a nucleic acid or nucleic acid fragment, construct and/or a vector according to the present invention.

In a further aspect of the present invention there is provided a method of modifying protein binding, metal chelation, antioxidation, and/or UV-light absorption in a plant, said method including introducing into said plant an effective amount of a nucleic acid or nucleic acid fragment, construct and/or a vector according to the present invention.

In a further aspect of the present invention there is provided a method of modifying pigment production in a plant, said method including introducing into said plant an effective amount of a nucleic acid or nucleic acid fragment, construct and/or a vector according to the present invention.

In a further aspect of the present invention there is provided a method of modifying plant defense to biotic stresses such as viruses, micro-organisms, insects and fungal pathogens, said method including introducing into said plant an effective amount of a nucleic acid or nucleic acid fragment, construct and/or a vector according to the present invention.

In a further aspect of the present invention there is provided a method of modifying forage quality of a plant by disrupting protein foam and/or conferring protection from rumen pasture bloat, said method including introducing into said plant an effective amount of a nucleic acid or nucleic acid fragment, construct and/or a vector according to the present invention.

By "an effective amount" it is meant an amount sufficient to result in an identifiable phenotypic trait in said plant, or a plant, plant seed or other plant part derived therefrom. Such amounts can be readily determined by an appropriately skilled person, taking into account the type of plant, the route of administration and other relevant factors. Such a person will readily be able to determine a suitable amount and method of administration. See, for example, Maniatis et al, Molecular Cloning: A Laboratory Manual, Cold Spring Harbor Laboratory, Cold Spring Harbor, the entire disclosure of which is incorporated herein by reference.

Using the methods and materials of the present invention, flavonoid biosynthesis, protein binding, metal chelation, antioxidation, UV-light absorption, tolerance to biotic stresses such as viruses, micro-organisms, insects and fungal pathogens; pigmentation in for example flowers and leaves; herbage quality and bloat-safety; and/or isoflavonoid content leading to health benefits, may be increased or otherwise modified, for example by incorporating additional copies of a sense nucleic acid or nucleic acid fragment of the present invention. They may be decreased or otherwise modified, for example by incorporating an antisense nucleic acid or nucleic acid fragment of the present invention.

The present invention will now be more fully described with reference to the accompanying Examples and drawings. It should be understood, however, that the description following is illustrative only and should not be taken in any way as a restriction on the generality of the invention described above.

BRIEF DESCRIPTION OF THE DRAWINGS

FIG. 1 shows the consensus contig nucleotide sequence of TrCHIa (SEQ ID NO: 1).

FIG. 2 shows the deduced amino acid sequence of TrCHIa (SEQ ID NO: 2).

FIG. 3 shows the nucleotide sequences of the nucleic acid fragments contributing to the consensus contig sequence TrCHIa (TrCHIa1: SEQ ID NO: 3; TrCHIa2: SEQ ID NO: 4; TrCHIa3: SEQ ID NO: 5; TrCHIa4: SEQ ID NO: 6; TrCHIa5: SEQ ID NO: 7).

FIG. 4 shows the consensus contig nucleotide sequence of TrCHIb (SEQ ID NO: 8).

FIG. 5 shows the deduced amino acid sequence of TrCHIb (SEQ ID NO: 9).

FIG. 6 shows the nucleotide sequences of the nucleic acid fragments contributing to the consensus contig sequence TrCHIb (TrCHIb1: SEQ ID NO: 10; TrCHIb2: SEQ ID NO: 11; TrCHIb3: SEQ ID NO: 12).

FIG. 7 shows the consensus contig nucleotide sequence of TrCHIc (SEQ ID NO: 13).

FIG. 8 shows the deduced amino acid sequence of TrCHIc (SEQ ID NO: 14).

FIG. 9 shows the nucleotide sequences of the nucleic acid fragments contributing to the consensus contig sequence TrCHIc (TrCHIc1: SEQ ID NO: 15; TrCHIc2: SEQ ID NO: 16).

FIG. 10 shows the consensus contig nucleotide sequence of TrCHId (SEQ ID NO: 17).

FIG. 11 shows the deduced amino acid sequence of TrCHId (SEQ ID NO: 18).

FIG. 12 shows the nucleotide sequences of the nucleic acid fragments contributing to the consensus contig sequence TrCHId (TrCHId1: SEQ ID NO: 19; TrCHId2: SEQ ID NO: 20; TrCHId3: SEQ ID NO: 21; TrCHId4: SEQ ID NO: 22).

FIG. 13 shows the consensus contig nucleotide sequence of TrCHSa (SEQ ID NO: 23).

FIG. 14 shows the deduced amino acid sequence of TrCHSa (SEQ ID NO: 24).

Figure 15:
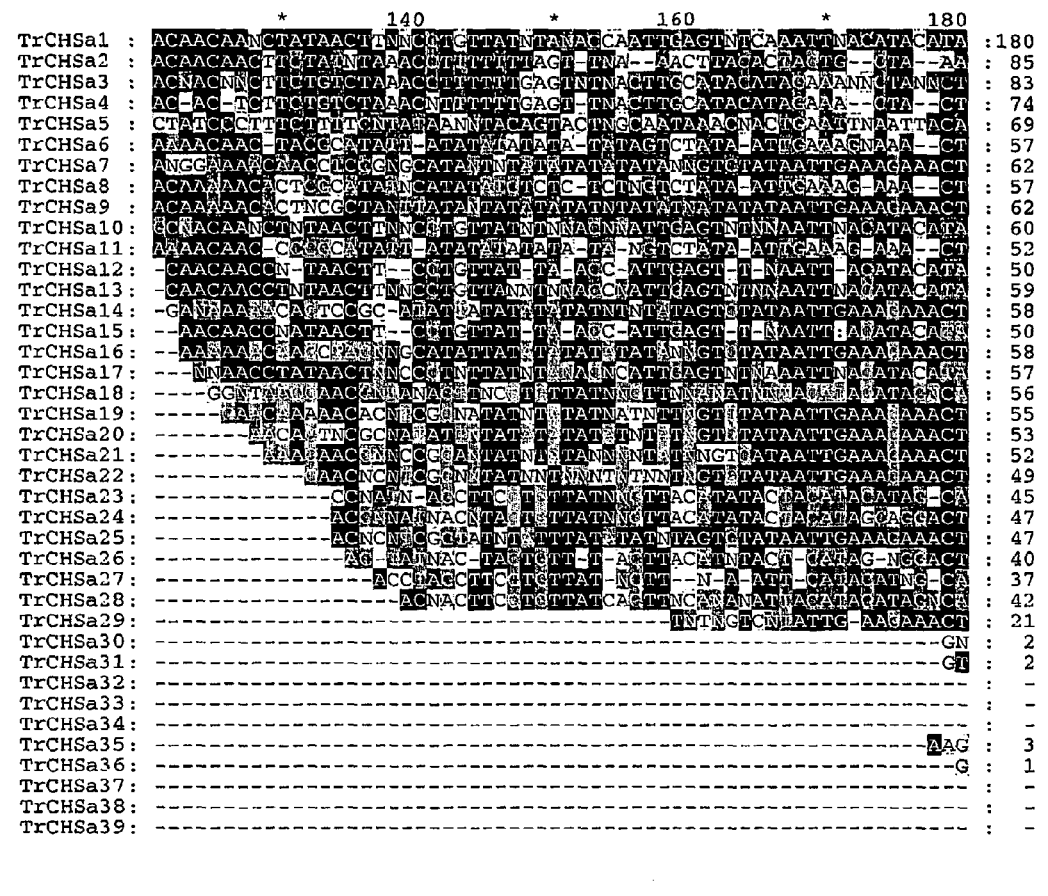
Figure 15:
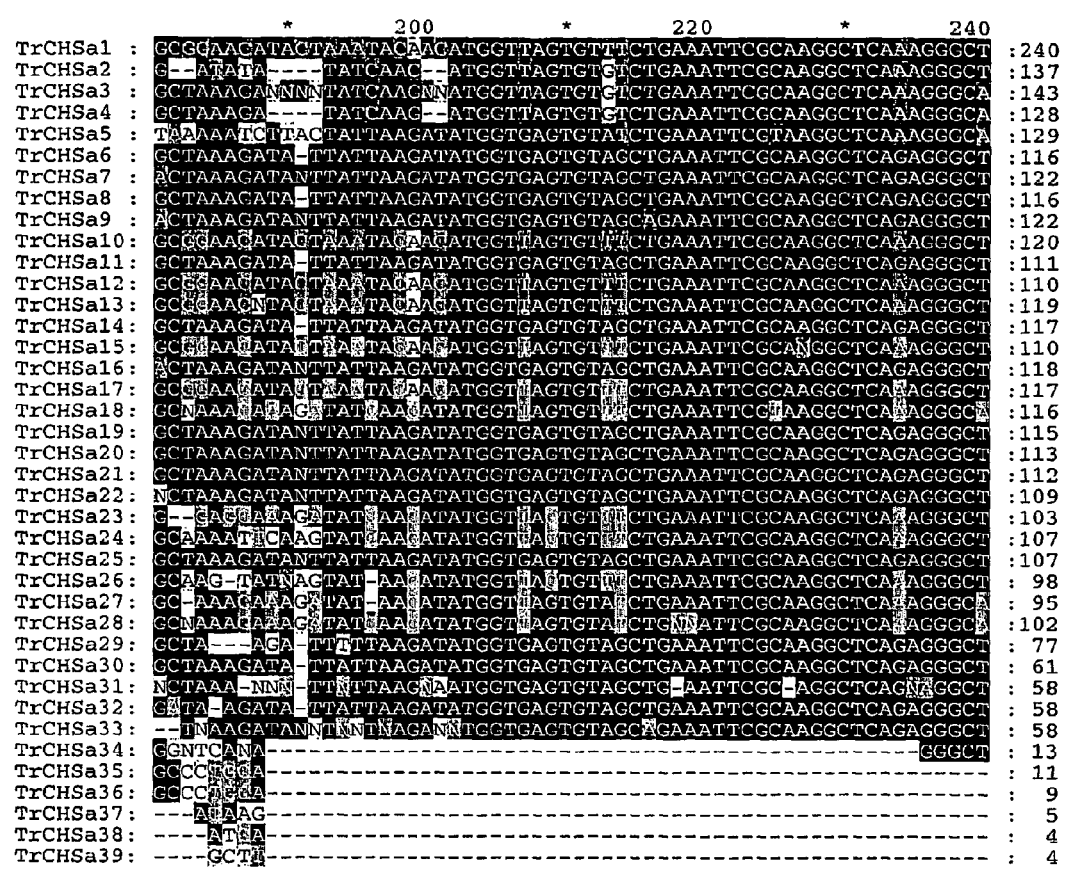
Figure 15:
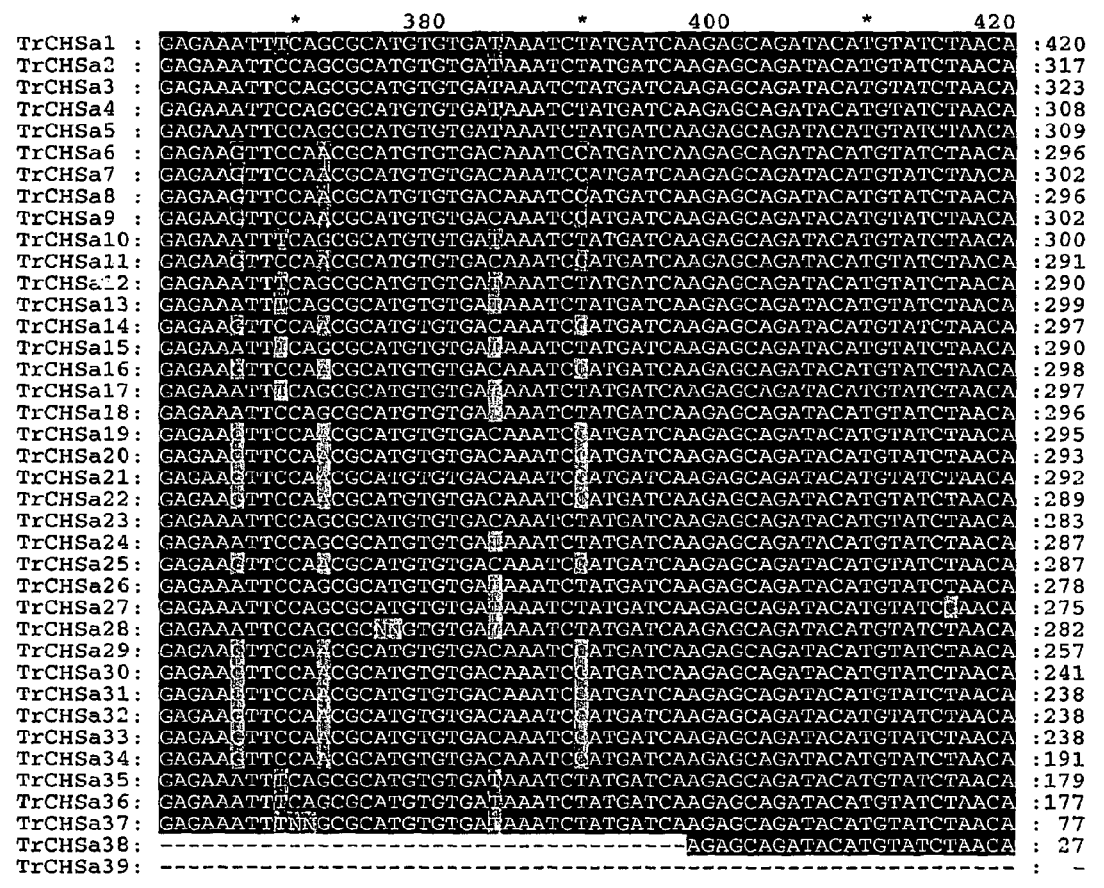

FIG. 15 shows the nucleotide sequences of the nucleic acid fragments contributing to the consensus contig sequence TrCHSa (TrCHSa1: SEQ ID NO: 25; TrCHSa2: SEQ ID NO: 26; TrCHSa3: SEQ ID NO: 27; TrCHSa4: SEQ ID NO: 28; TrCHSa5: SEQ ID NO: 29; TrCHSa6: SEQ ID NO: 30; TrCHSa7: SEQ ID NO: 31; TrCHSa8: SEQ ID NO: 32; TrCHSa9: SEQ ID NO: 33; TrCHSa10: SEQ ID NO: 34; TrCHSa11: SEQ ID NO: 35; TrCHSa12: SEQ ID NO: 36; TrCHSa13: SEQ ID NO: 37; TrCHSa14: SEQ ID NO: 38; TrCHSa15: SEQ ID NO: 39; TrCHSa16: SEQ ID NO: 40; TrCHSa17: SEQ ID NO: 41; TrCHSa18: SEQ ID NO: 42; TrCHSa19: SEQ ID NO: 43; TrCHSa20: SEQ ID NO: 44; TrCHSa21: SEQ ID NO: 45; TrCHSa22: SEQ ID NO: 46; TrCHSa23: SEQ ID NO: 47; TrCHSa24: SEQ ID NO: 48; TrCHSa25: SEQ ID NO: 49; TrCHSa26: SEQ ID NO: 50; TrCHSa27: SEQ ID NO: 51; TrCHSa28: SEQ ID NO: 52; TrCHSa29: SEQ ID NO: 53; TrCHSa30: SEQ ID NO: 54; TrCHSa31: SEQ ID NO: 55; TrCHSa32: SEQ ID NO: 56; TrCHSa33: SEQ ID NO: 57; TrCHSa34: SEQ ID NO: 58; TrCHSa35: SEQ ID NO: 59; TrCHSa36: SEQ ID NO: 60; TrCHSa37: SEQ ID NO: 61; TrCHSa38: SEQ ID NO: 62; TrCHSa39: SEQ ID NO: 63).

FIG. 16 shows the consensus contig nucleotide sequence of TrCHSb (SEQ ID NO: 64).

FIG. 17 shows the deduced amino acid sequence of TrCHSb (SEQ ID NO: 65).

FIG. 18 shows the nucleotide sequences of the nucleic acid fragments contributing to the consensus contig sequence TrCHSb (TrCHSb1: SEQ ID NO: 66; TrCHSb2: SEQ ID NO: 67; TrCHSb3: SEQ ID NO: 68).

FIG. 19 shows the consensus contig nucleotide sequence of TrCHSc (SEQ ID NO: 69).

FIG. 20 shows the deduced amino acid sequence of TrCHSc (SEQ ID NO: 70).

FIG. 21 shows the nucleotide sequences of the nucleic acid fragments contributing to the consensus contig sequence TrCHSc (TrCHSc1: SEQ ID NO: 71; TrCHSc2: SEQ ID NO: 72; TrCHSc3: SEQ ID NO: 73; TrCHSc4: SEQ ID NO: 74; TrCHSc5: SEQ ID NO: 75; TrCHSc6: SEQ ID NO: 76; TrCHSc7: SEQ ID NO: 77).

FIG. 22 shows the consensus contig nucleotide sequence of TrCHSd (SEQ ID NO: 78).

FIG. 23 shows the deduced amino acid sequence of TrCHSd (SEQ ID NO: 79).

FIG. 24 shows the nucleotide sequences of the nucleic acid fragments contributing to the consensus contig sequence TrCHSd (TrCHSd1: SEQ ID NO: 80; TrCHSd1: SEQ ID NO: 81; TrCHSd1: SEQ ID NO: 82; TrCHSd1: SEQ ID NO: 83; TrCHSd1: SEQ ID NO: 84; TrCHSd1: SEQ ID NO: 85; TrCHSd1: SEQ ID NO: 86; TrCHSd1: SEQ ID NO: 87; TrCHSd1: SEQ ID NO: 88; TrCHSd1: SEQ ID NO: 89; TrCHSd1: SEQ ID NO: 90).

FIG. 25 shows the consensus contig nucleotide sequence of TrCHSe (SEQ ID NO: 91).

FIG. 26 shows the deduced amino acid sequence of TrCHSe (SEQ ID NO: 92).

FIG. 27 shows the nucleotide sequences of the nucleic acid fragments contributing to the consensus contig sequence TrCHSe (TrCHSe1: SEQ ID NO: 93; TrCHSe2: SEQ ID NO: 94).

FIG. 28 shows the consensus contig nucleotide sequence of TrCHSf (SEQ ID NO: 95).

FIG. 29 shows the deduced amino acid sequence of TrCHSf (SEQ ID NO: 96).

FIG. 30 shows the nucleotide sequences of the nucleic acid fragments contributing to the consensus contig sequence TrCHSf (TrCHSf1: SEQ ID NO: 97; TrCHSf2: SEQ ID NO: 98; TrCHSf1: SEQ ID NO: 99; TrCHSf1: SEQ ID NO: 100).

FIG. 31 shows the consensus contig nucleotide sequence of TrCHSg (SEQ ID NO: 101).

FIG. 32 shows the deduced amino acid sequence of TrCHSg (SEQ ID NO: 102).

FIG. 33 shows the nucleotide sequences of the nucleic acid fragments contributing to the consensus contig sequence TrCHSg (TrCHSg1: SEQ ID NOs: 103; TrCHSg2: SEQ ID NOs: 104; TrCHSg3: SEQ ID NOs: 105).

FIG. 34 shows the consensus contig nucleotide sequence of TrCHSh (SEQ ID NO: 106).

FIG. 35 shows the deduced amino acid sequence of TrCHSh (SEQ ID NO: 107).

FIG. 36 shows the nucleotide sequence of TrCHRa (SEQ ID NO: 108).

FIG. 37 shows the deduced amino acid sequence of TrCHRa (SEQ ID NO: 109).

FIG. 38 shows the consensus contig nucleotide sequence of TrCHRb (SEQ ID NO: 110).

FIG. 39 shows the deduced amino acid sequence of TrCHRb (SEQ ID NO: 111).

FIG. 40 shows the nucleotide sequences of the nucleic acid fragments contributing to the consensus contig sequence TrCHRb (TrCHRb1: SEQ ID NO: 112; TrCHRb2: SEQ ID NO: 113; TrCHRb3: SEQ ID NO: 114; TrCHRb4: SEQ ID NO: 115; TrCHRb5: SEQ ID NO: 116).

FIG. 41 shows the consensus contig nucleotide sequence of TrCHRc (SEQ ID NO: 117).

FIG. 42 shows the deduced amino acid sequence of TrCHRc (SEQ ID NO: 118).

FIG. 43 shows the nucleotide sequences of the nucleic acid fragments contributing to the consensus contig sequence TrCHRc (TrCHRc1: SEQ ID NO: 119; TrCHRc2: SEQ ID NO: 120; TrCHRc3: SEQ ID NO: 121; TrCHRc4: SEQ ID NO: 122; TrCHRc5: SEQ ID NO: 123; TrCHRc6: SEQ ID NO: 124; TrCHRc7: SEQ ID NO: 125; TrCHRc8: SEQ ID NO: 126; TrCHRc9: SEQ ID NO: 127; TrCHRc10: SEQ ID NO: 128; TrCHRc11: SEQ ID NO: 129; TrCHRc12: SEQ ID NO: 130; TrCHRc13: SEQ ID NO: 131; TrCHRc14: SEQ ID NO: 132; TrCHRc15: SEQ ID NO: 133; TrCHRc16: SEQ ID NO: 134).

FIG. 44 shows the consensus contig nucleotide sequence of TrDFRa (SEQ ID NO: 135).

FIG. 45 shows the deduced amino acid sequence of TrDFRa (SEQ ID NO: 136).

FIG. 46 shows the nucleotide sequences of the nucleic acid fragments contributing to the consensus contig sequence TrDFRa (TrDFRa1: SEQ ID NO: 137; TrDFRa2: SEQ ID NO: 138; TrDFRa3: SEQ ID NO: 139; TrDFRa4: SEQ ID NO: 140; TrDFRa5: SEQ ID NO: 141; TrDFRa6: SEQ ID NO: 142; TrDFRa7: SEQ ID NO: 143; TrDFRa8: SEQ ID NO: 144; TrDFRa9: SEQ ID NO: 145; TrDFRa10: SEQ ID NO: 146).

FIG. 47 shows the consensus contig nucleotide sequence of TrDFRb (SEQ ID NO: 147).

FIG. 48 shows the deduced amino acid sequence of TrDFRb (SEQ ID NO: 148).

FIG. 49 shows the nucleotide sequences of the nucleic acid fragments contributing to the consensus contig sequence TrDFRb (TrDFRb1: SEQ ID NO: 149; TrDFRb2: SEQ ID NO: 150; TrDFRb3: SEQ ID NO: 151; TrDFRb4: SEQ ID NO: 152).

FIG. 50 shows the nucleotide sequence of TrDFRc (SEQ ID NO: 153).

FIG. 51 shows the deduced amino acid sequence of TrDFRc (SEQ ID NO: 154).

FIG. 52 shows the consensus contig nucleotide sequence of TrDFRd (SEQ ID NO: 155).

FIG. 53 shows the deduced amino acid sequence of TrDFRd (SEQ ID NO: 156).

FIG. 54 shows the nucleotide sequences of the nucleic acid fragments contributing to the consensus contig sequence TrDFRd (TrDFRd1: SEQ ID NO: 157; TrDFRd2: SEQ ID NO: 158).

FIG. 55 shows the nucleotide sequence of TrDFRe (SEQ ID NO: 159).

FIG. 56 shows the deduced amino acid sequence of TrDFRe (SEQ ID NO: 160).

FIG. 57 shows the nucleotide sequence of TrDFRf (SEQ ID NO: 161).

FIG. 58 shows the deduced amino acid sequence of TrDFRf (SEQ ID NO: 162).

FIG. 59 shows the consensus contig nucleotide sequence of TrDFRg (SEQ ID NO: 163).

FIG. 60 shows the deduced amino acid sequence of TrDFRg (SEQ ID NO: 164).

FIG. 61 shows the nucleotide sequences of the nucleic acid fragments contributing to the consensus contig sequence TrDFRg (TrDFRg1: SEQ ID NO: 165; TrDFRg2: SEQ ID NO: 166; TrDFRg3: SEQ ID NO: 167).

FIG. 62 shows the consensus contig nucleotide sequence of TrDFRh (SEQ ID NO: 168).

FIG. 63 shows the deduced amino acid sequence of TrDFRh (SEQ ID NO: 169).

FIG. 64 shows the nucleotide sequences of the nucleic acid fragments contributing to the consensus contig sequence TrDFRh (TrDFRh1: SEQ ID NO: 170; TrDFRh2: SEQ ID NO: 171; TrDFRh3: SEQ ID NO: 172; TrDFRh4: SEQ ID NO: 173; TrDFRh5: SEQ ID NO: 174; TrDFRh6: SEQ ID NO: 175; TrDFRh7: SEQ ID NO: 176; TrDFRh8: SEQ ID NO: 177; TrDFRh9: SEQ ID NO: 178; TrDFRh10: SEQ ID NO: 179; TrDFRh11: SEQ ID NO: 180; TrDFRh12: SEQ ID NO: 181; TrDFRh13: SEQ ID NO: 182; TrDFRh14: SEQ ID NO: 183; TrDFRh15: SEQ ID NO: 184).

FIG. 65 shows the consensus contig nucleotide sequence of TrLCRa (SEQ ID NO: 185).

FIG. 66 shows the deduced amino acid sequence of TrLCRa (SEQ ID NO: 186).

FIG. 67 shows the nucleotide sequences of the nucleic acid fragments contributing to the consensus contig sequence TrLCRa (TrLCRa1: SEQ ID NO: 187; TrLCRa2: SEQ ID NO: 188; TrLCRa3: SEQ ID NO: 189; TrLCRa4: SEQ ID NO: 190; TrLCRa5: SEQ ID NO: 191; TrLCRa6: SEQ ID NO: 192; TrLCRa7: SEQ ID NO: 193).

FIG. 68 shows the nucleotide sequence of TrF3'5'Ha (SEQ ID NO: 194).

FIG. 69 shows the deduced amino acid sequence of TrF3'5'Ha (SEQ ID NO: 195).

FIG. 70 shows the consensus contig nucleotide sequence of TrF3'5'Hb (SEQ ID NO: 196).

FIG. 71 shows the deduced amino acid sequence of TrF3'5'Hb (SEQ ID NO: 197).

FIG. 72 shows the nucleotide sequences of the nucleic acid fragments contributing to the consensus contig sequence TrF3'5'Hb (TrF3'5'Hb1: SEQ ID NO: 198; TrF3'5'Hb2: SEQ ID NO: 199; TrF3'5'Hb3: SEQ ID NO: 200; TrF3'5'Hb4: SEQ ID NO: 201).

FIG. 73 shows the consensus contig nucleotide sequence of TrF3Ha (SEQ ID NO: 202).

FIG. 74 shows the deduced amino acid sequence of TrF3Ha (SEQ ID NO: 203).

FIG. 75 shows the nucleotide sequences of the nucleic acid fragments contributing to the consensus contig sequence TrF3Ha (TrF3Ha1: SEQ ID NO: 204; TrF3Ha2: SEQ ID NO: 205; TrF3Ha3: SEQ ID NO: 206; TrF3Ha4: SEQ ID NO: 207; TrF3Ha5: SEQ ID NO: 208; TrF3Ha6: SEQ ID NO: 209; TrF3Ha7: SEQ ID NO: 210; TrF3Ha8: SEQ ID NO: 211; TrF3Ha9: SEQ ID NO: 212; TrF3Ha10: SEQ ID NO: 213; TrF3Ha11: SEQ ID NO: 214; TrF3Ha12: SEQ ID NO: 215; TrF3Ha13: SEQ ID NO: 216; TrF3Ha14: SEQ ID NO: 217; TrF3Ha15: SEQ ID NO: 218; TrF3Ha16: SEQ ID NO: 219; TrF3Ha17: SEQ ID NO: 220; TrF3Ha18: SEQ ID NO: 221; TrF3Ha19: SEQ ID NO: 222; TrF3Ha20: SEQ ID NO: 223; TrF3Ha21: SEQ ID NO: 224; TrF3Ha22: SEQ ID NO: 225; TrF3Ha23: SEQ ID NO: 226; TrF3Ha24: SEQ ID NO: 227; TrF3Ha25: SEQ ID NO: 228; TrF3Ha26: SEQ ID NO: 229; TrF3Ha27: SEQ ID NO: 230; TrF3Ha28: SEQ ID NO: 231; TrF3Ha29: SEQ ID NO: 232; TrF3Ha30: SEQ ID NO: 233; TrF3Ha31: SEQ ID NO: 234; TrF3Ha32: SEQ ID NO: 235; TrF3Ha33: SEQ ID NO: 236; TrF3Ha34: SEQ ID NO: 237; TrF3Ha35: SEQ ID NO: 238; TrF3Ha36: SEQ ID NO: 239;

Figure 110:
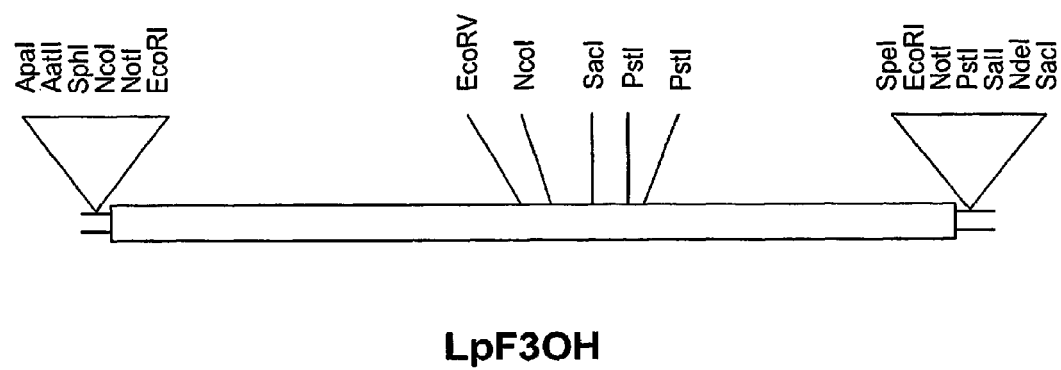

TrF3Ha37: SEQ ID NO: 240; TrF3Ha38: SEQ ID NO: 241; TrF3Ha39: SEQ ID NO: 242; TrF3Ha40: SEQ ID NO: 243; TrF3Ha41: SEQ ID NO: 244).

FIG. 76 shows the nucleotide sequence of TrF3Hb (SEQ ID NO: 245).

FIG. 77 shows the deduced amino acid sequence of TrF3Hb (SEQ ID NO: 246).

FIG. 78 shows the nucleotide sequence of TrF3Hc (SEQ ID NO: 247).

FIG. 79 shows the deduced amino acid sequence of TrF3Hc (SEQ ID NO: 248).

FIG. 80 shows the consensus contig nucleotide sequence of TrF3'Ha (SEQ ID NO: 249).

FIG. 81 shows the deduced amino acid sequence of TrF3'Ha (SEQ ID NO: 250).

FIG. 82 shows the nucleotide sequences of the nucleic acid fragments contributing to the consensus contig sequence TrF3'Ha (TrF3'Ha1: SEQ ID NO: 251; TrF3'Ha2: SEQ ID NO: 252).

FIG. 83 shows the consensus contig nucleotide sequence of TrPALa (SEQ ID NO: 253).

FIG. 84 shows the deduced amino acid sequence of TrPALa (SEQ ID NO: 254).

FIG. 85 shows the nucleotide sequences of the nucleic acid fragments contributing to the consensus contig sequence TrPALa (TrPALa1: SEQ ID NO: 255; TrPALa2: SEQ ID NO: 256; TrPALa3: SEQ ID NO: 257).

FIG. 86 shows the consensus contig nucleotide sequence of TrPALb (SEQ ID NO: 258).

FIG. 87 shows the deduced amino acid sequence of TrPALb (SEQ ID NO: 259).

FIG. 88 shows the nucleotide sequences of the nucleic acid fragments contributing to the consensus contig sequence TrPALb (TrPALb1: SEQ ID NO: 260; TrPALb2: SEQ ID NO: 261; TrPALb3: SEQ ID NO: 262; TrPALb4: SEQ ID NO: 263; TrPALb5: SEQ ID NO: 264; TrPALb6: SEQ ID NO: 265; TrPALb7: SEQ ID NO: 266; TrPALb8: SEQ ID NO: 267).

FIG. 89 shows the nucleotide sequence of TrPALc (SEQ ID NO: 268).

FIG. 90 shows the deduced amino acid sequence of TrPALc (SEQ ID NO: 269).

FIG. 91 shows the nucleotide sequence of TrPALd (SEQ ID NO: 270).

FIG. 92 shows the deduced amino acid sequence of TrPALd (SEQ ID NO: 271).

FIG. 93 shows the nucleotide sequence of TrPALe (SEQ ID NO: 272).

FIG. 94 shows the deduced amino acid sequence of TrPALe (SEQ ID NO: 273).

FIG. 95 shows the consensus contig nucleotide sequence of TrPALf (SEQ ID NO: 274).

FIG. 96 shows the deduced amino acid sequence of TrPALf (SEQ ID NO: 275).

FIG. 97 shows the nucleotide sequences of the nucleic acid fragments contributing to the consensus contig sequence TrPALf (TrPALf1: SEQ ID NO: 276; TrPALf2: SEQ ID NO: 277).

FIG. 98 shows the consensus contig nucleotide sequence of TrVRa (SEQ ID NO: 278).

FIG. 99 shows the deduced amino acid sequence of TrVRa (SEQ ID NO: 279).

FIG. 100 shows the nucleotide sequences of the nucleic acid fragments contributing to the consensus contig sequence TrVRa (TrVRa1: SEQ ID NO: 280; TrVRa2: SEQ ID NO: 281; TrVRa3: SEQ ID NO: 282; TrVRa4: SEQ ID NO: 283; TrVRa5: SEQ ID NO: 284; TrVRa6: SEQ ID NO: 285).

FIG. 101 shows the consensus contig nucleotide sequence of LpDFRa (SEQ ID NO: 286).

FIG. 102 shows the deduced amino acid sequence of LpDFRa (SEQ ID NO: 287).

FIG. 103 shows the nucleotide sequences of the nucleic acid fragments contributing to the consensus contig sequence LpDFRa (LpDFRa1: SEQ ID NO: 288; LpDFRa2: SEQ ID NO: 289; LpDFRa3: SEQ ID NO: 290; LpDFRa4: SEQ ID NO: 291; LpDFRa5: SEQ ID NO: 292).

FIG. 104 shows the consensus contig nucleotide sequence of LpDFRb (SEQ ID NO: 293).

FIG. 105 shows the deduced amino acid sequence of LpDFRb (SEQ ID NO: 294).

FIG. 106 shows the nucleotide sequences of the nucleic acid fragments contributing to the consensus contig sequence LpDFRb (LpDFRb1: SEQ ID NO: 295; LpDFRb2: SEQ ID NO: 296; LpDFRb3: SEQ ID NO: 297).

FIG. 107 shows the consensus contig nucleotide sequence of LpF3Ha (SEQ ID NO: 298).

FIG. 108 shows the deduced amino acid sequence of LpF3Ha (SEQ ID NO: 299).

FIG. 109 shows the nucleotide sequences of the nucleic acid fragments contributing to the consensus contig sequence LpF3Ha (LpF3Ha1: SEQ ID NO: 300; LpF3Ha2: SEQ ID NO: 301; LpF3Ha3: SEQ ID NO: 302).

FIG. 110 shows a plasmid map of the cDNA encoding perennial ryegrass F3OH.

FIG. 111 shows the full nucleotide sequence of perennial ryegrass F3OH cDNA (SEQ ID NO: 303).

FIG. 112 shows the deduced amino acid sequence of perennial ryegrass F3OH cDNA (SEQ ID NO: 304).

FIG. 113 shows plasmid maps of sense and antisense constructs of LpF3OH in pDH51 transformation vector.

Figure 114:
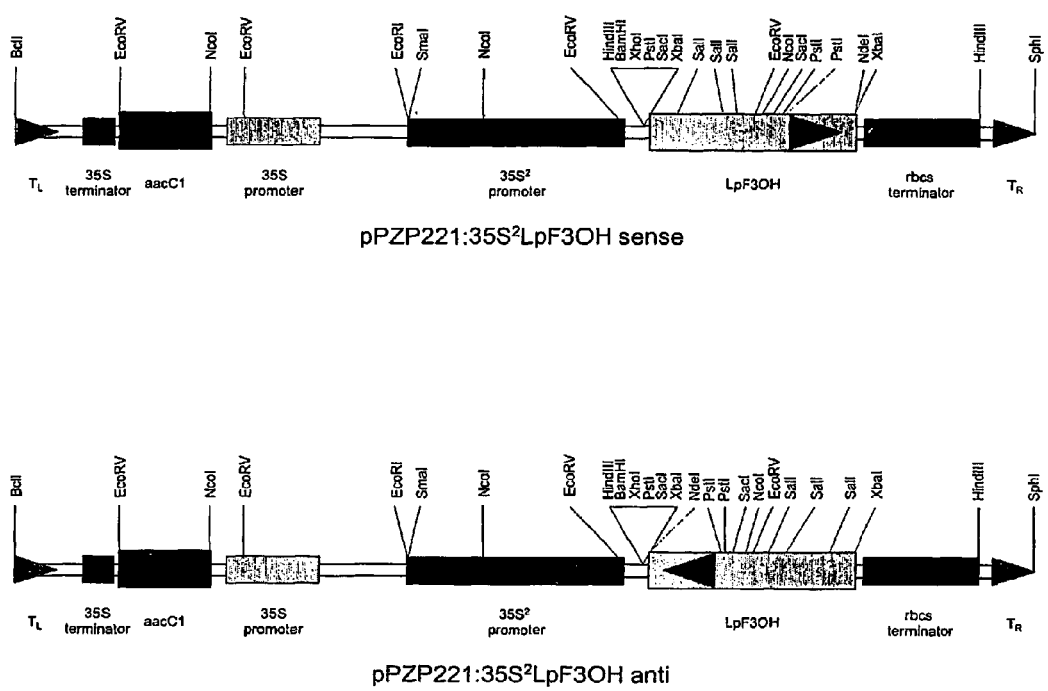

FIG. 114 shows plasmid maps of sense and antisense constructs of LpF3OH in pPZP221:35 S2 binary transformation vector.

Figure 115:
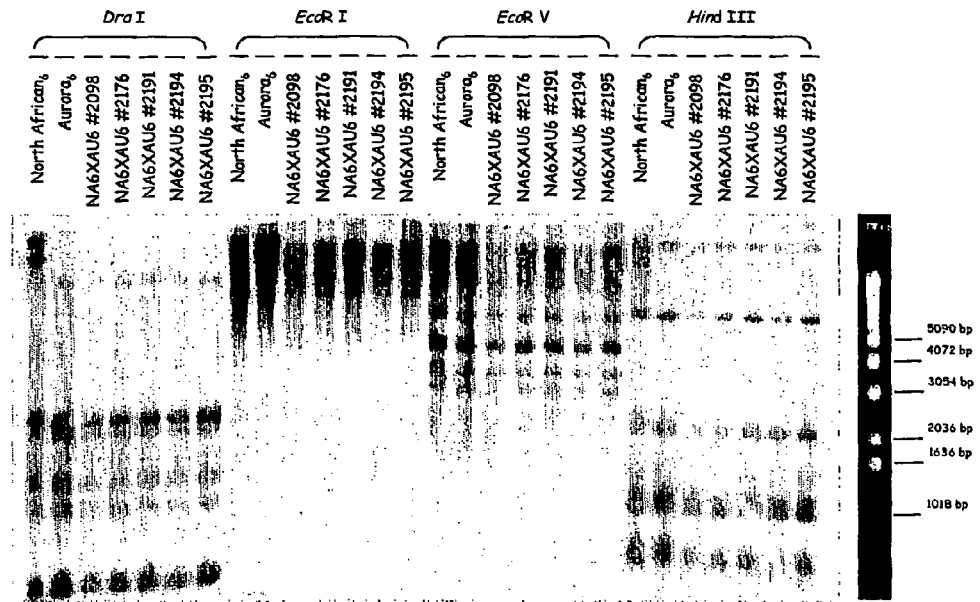

FIG. 115 shows screening by Southern hybridization for RFLPs using LpF3OH as a probe.

Figure 116:
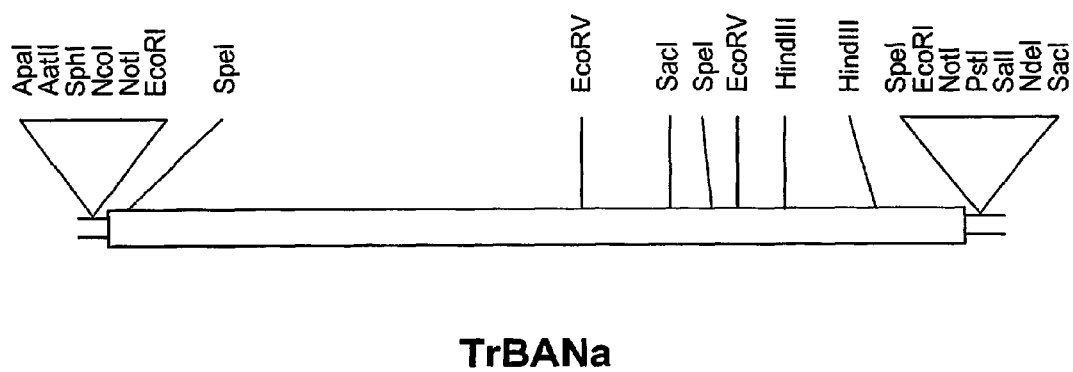

FIG. 116 shows a plasmid map of the cDNA encoding white clover BANa.

FIG. 117 shows the full nucleotide sequence of white clover BANa cDNA (SEQ ID NO: 305).

FIG. 118 shows the deduced amino acid sequence of white clover BANa cDNA (SEQ ID NO: 306).

FIG. 119 shows plasmid maps of sense and antisense constructs of TrBANa in pDH51 transformation vector.

Figure 120:
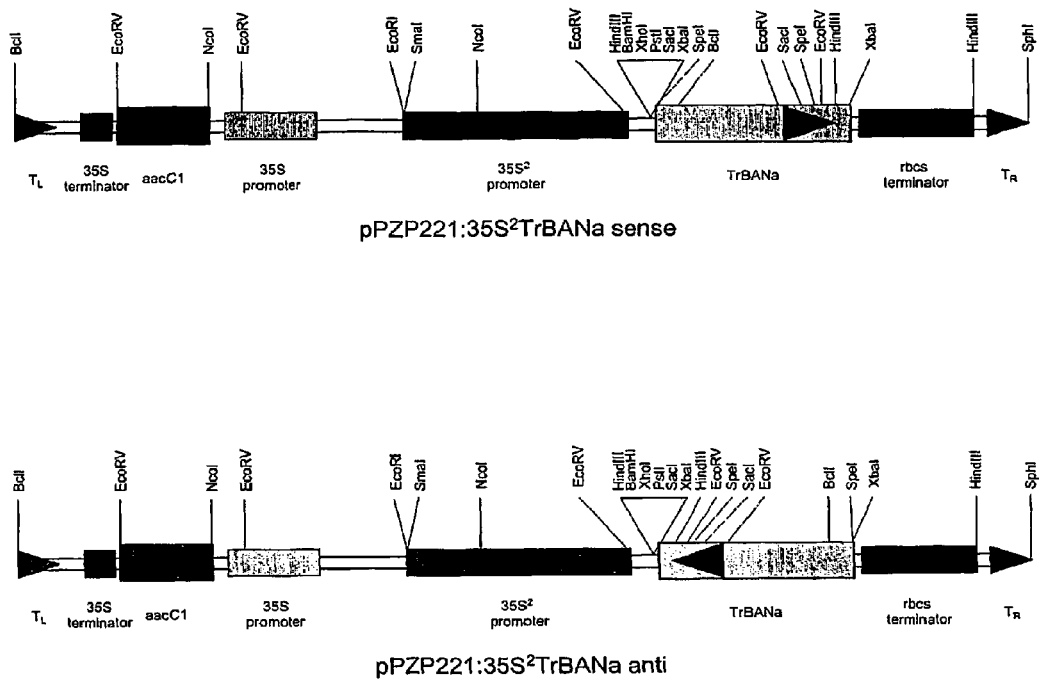

FIG. 120 shows plasmid maps of sense and antisense constructs of TrBANa in pPZP221:35 S2 binary transformation vector.

Figure 121:
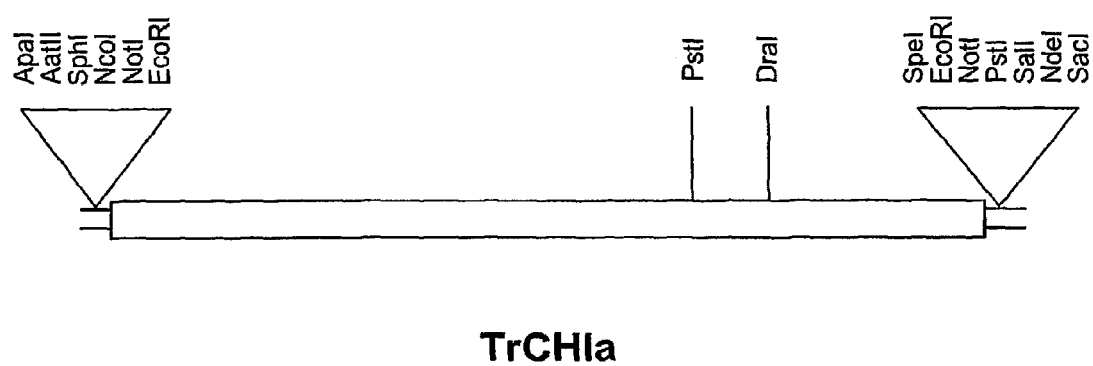

FIG. 121 shows a plasmid map of the cDNA encoding white clover CHIa.

FIG. 122 shows the full nucleotide sequence of white clover CHIa cDNA (SEQ ID NO: 307).

FIG. 123 shows the deduced amino acid sequence of white clover CHIa cDNA (SEQ ID NO: 308).

FIG. 124 shows plasmid maps of sense and antisense constructs of TrCHIa in pDH51 transformation vector.

FIG. 125 shows plasmid maps of sense and antisense constructs of TrCHIa in pPZP221:35 S2 binary transformation vector.

Figure 126:
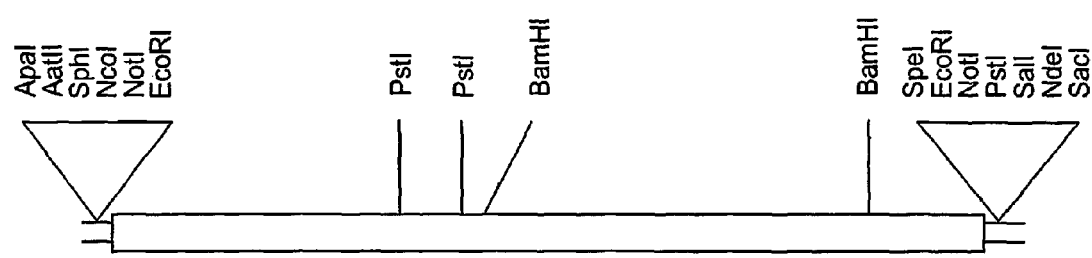

FIG. 126 shows a plasmid map of the cDNA encoding white clover CHId.

FIG. 127 shows the full nucleotide sequence of white clover CHId cDNA (SEQ ID NO: 309).

FIG. 128 shows the deduced amino acid sequence of white clover CHId cDNA (SEQ ID NO: 310).

FIG. 129 shows plasmid maps of sense and antisense constructs of TrCHId in pDH51 transformation vector.

FIG. 130 shows plasmid maps of sense and antisense constructs of TrCHId in pPZP221:35 S2 binary transformation vector.

Figure 131:
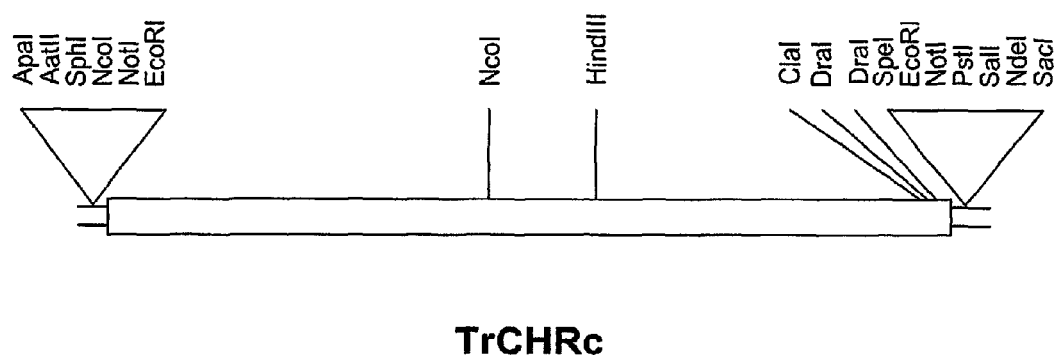

FIG. 131 shows a plasmid map of the cDNA encoding white clover CHRc.

FIG. 132 shows the full nucleotide sequence of white clover CHRc cDNA (SEQ ID NO: 311).

FIG. 133 shows the deduced amino acid sequence of white clover CHRc cDNA (SEQ ID NO: 312).

FIG. 134 shows plasmid maps of sense and antisense constructs of TrCHRc in pDH51 transformation vector.

FIG. 135 shows plasmid maps of sense and antisense constructs of TrCHRc in pPZP221:35 S2 binary transformation vector.

Figure 136:

FIG. 136 shows a plasmid map of the cDNA encoding white clover CHSa1.

FIG. 137 shows the full nucleotide sequence of white clover CHSa1 cDNA (SEQ ID NO: 313).

FIG. 138 shows the deduced amino acid sequence of white clover CHSa1 cDNA (SEQ ID NO: 314).

FIG. 139 shows plasmid maps of sense and antisense constructs of TrCHSa1 in pDH51 transformation vector.

FIG. 140 shows plasmid maps of sense and antisense constructs of TrCHSa1 in pPZP221:35 S2 binary transformation vector.

Figure 141:
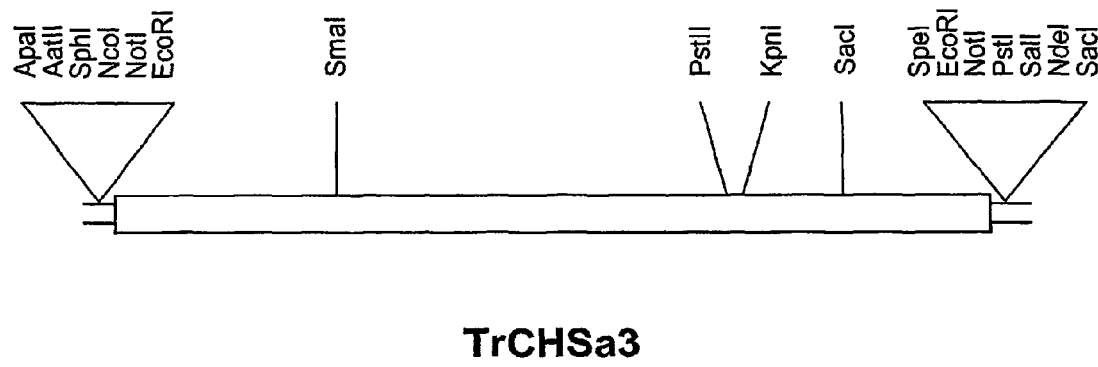

FIG. 141 shows a plasmid map of the cDNA encoding white clover CHSa3.

FIG. 142 shows the full nucleotide sequence of white clover CHSa3 cDNA (SEQ ID NO: 315).

FIG. 143 shows the deduced amino acid sequence of white clover CHSa3 cDNA (SEQ ID NO: 316).

FIG. 144 shows plasmid maps of sense and antisense constructs of TrCHSa3 in pDH51 transformation vector.

FIG. 145 shows plasmid maps of sense and antisense constructs of TrCHSa3 in pPZP221:35 S2 binary transformation vector.

Figure 146:
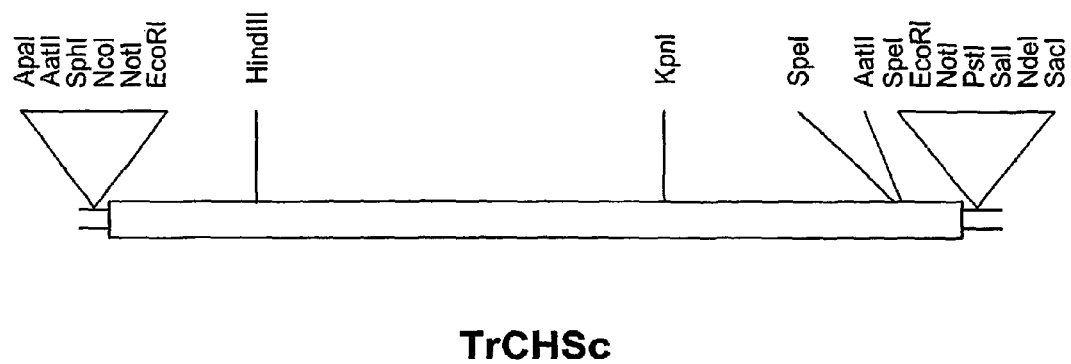

FIG. 146 shows a plasmid map of the cDNA encoding white clover CHSc.

FIG. 147 shows the full nucleotide sequence of white clover CHSc cDNA (SEQ ID NO: 317).

FIG. 148 shows the deduced amino acid sequence of white clover CHSc cDNA (SEQ ID NO: 318).

FIG. 149 shows plasmid maps of sense and antisense constructs of TrCHSc in pDH51 transformation vector.

Figure 150:
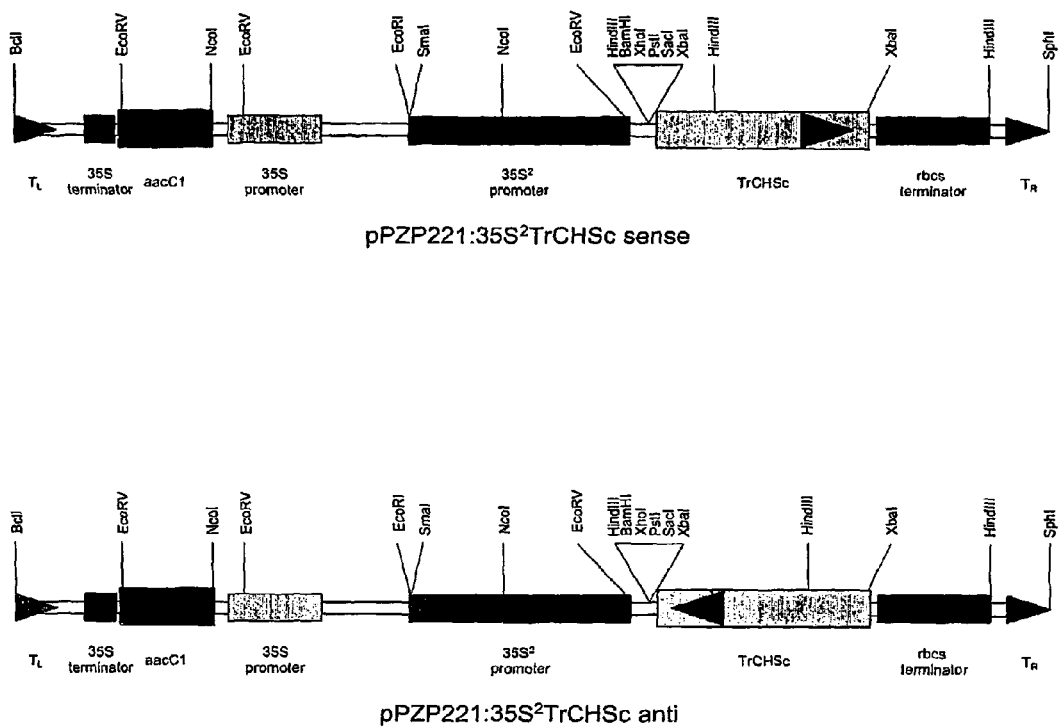

FIG. 150 shows plasmid maps of sense and antisense constructs of TrCHSc in pPZP221:35 S2 binary transformation vector.

Figure 151:
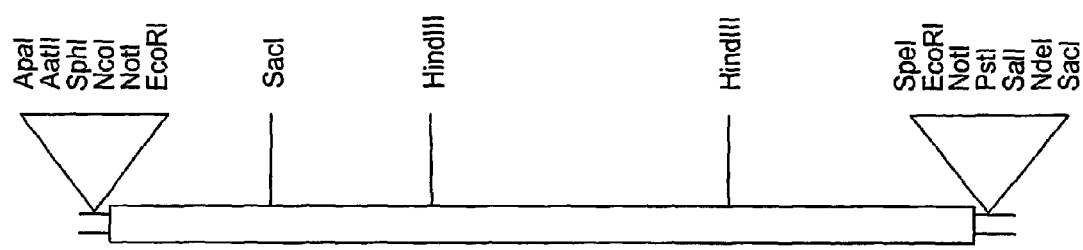

FIG. 151 shows a plasmid map of the cDNA encoding white clover CHSd2.

FIG. 152 shows the full nucleotide sequence of white clover CHSd2 cDNA (SEQ ID NO: 319).

FIG. 153 shows the deduced amino acid sequence of white clover CHSd2 cDNA (SEQ ID NO: 320).

FIG. 154 shows plasmid maps of sense and antisense constructs of TrCHSd2 in pDH51 transformation vector.

FIG. 155 shows plasmid maps of sense and antisense constructs of TrCHSd2 in pPZP221:35 S2 binary transformation vector.

Figure 156:
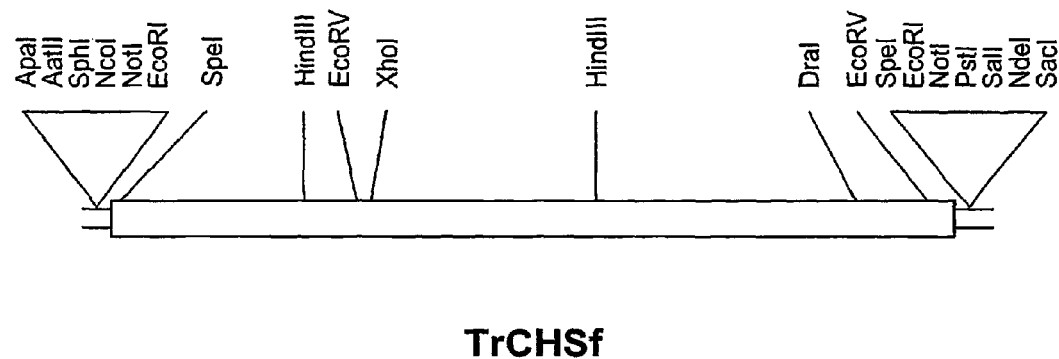

FIG. 156 shows a plasmid map of the cDNA encoding white clover CHSf.

FIG. 157 shows the full nucleotide sequence of white clover CHSf cDNA (SEQ ID NO: 321).

FIG. 158 shows the deduced amino acid sequence of white clover CHSf cDNA (SEQ ID NO: 322).

FIG. 159 shows plasmid maps of sense and antisense constructs of TrCHSf in pDH51 transformation vector.

FIG. 160 shows plasmid maps of sense and antisense constructs of TrCHSf in pPZP221:3552 binary transformation vector.

Figure 161:
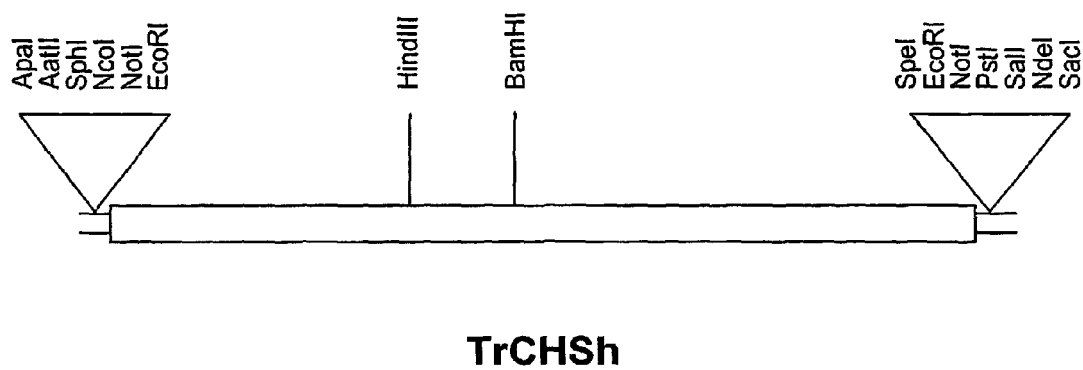

FIG. 161 shows a plasmid map of the cDNA encoding white clover CHSh.

FIG. 162 shows the full nucleotide sequence of white clover CHSh cDNA (SEQ ID NO: 323).

FIG. 163 shows the deduced amino acid sequence of white clover CHSh cDNA (SEQ ID NO: 324).

FIG. 164 shows plasmid maps of sense and antisense constructs of TrCHSh in pDH51 transformation vector.

FIG. 165 shows plasmid maps of sense and antisense constructs of TrCHSh in pPZP221:35 S2 binary transformation vector.

Figure 166:
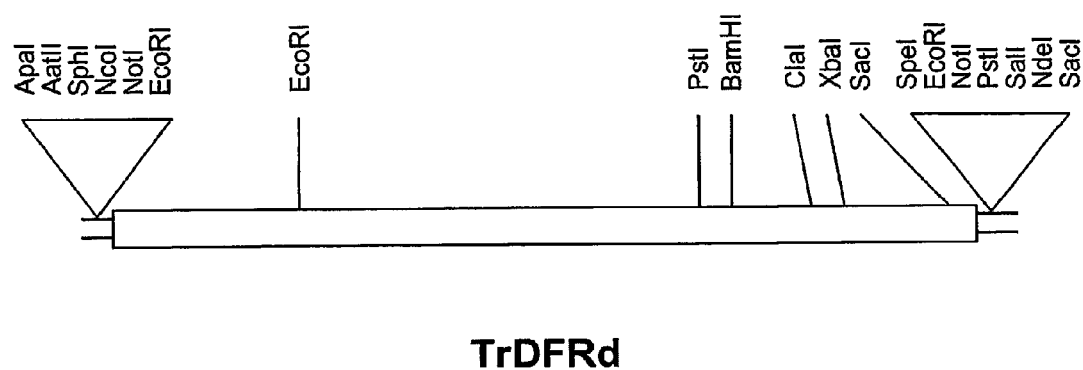

FIG. 166 shows a plasmid map of the cDNA encoding white clover DFRd.

FIG. 167 shows the full nucleotide sequence of white clover DFRd cDNA (SEQ ID NO: 325).

FIG. 168 shows the deduced amino acid sequence of white clover DFRd cDNA (SEQ ID NO: 326).

FIG. 169 shows plasmid maps of sense and antisense constructs of TrDFRd in pDH51 transformation vector.

FIG. 170 shows plasmid maps of sense and antisense constructs of TrDFRd in pPZP221:35 S2 binary transformation vector.

Figure 171:
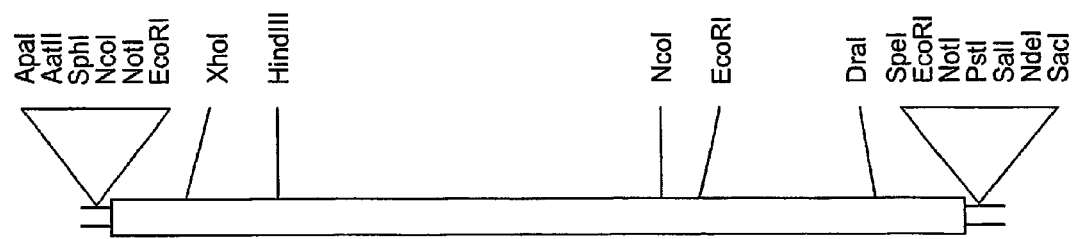

FIG. 171 shows a plasmid map of the cDNA encoding white clover F3Ha.

FIG. 172 shows the full nucleotide sequence of white clover F3Ha cDNA (SEQ ID NO: 327).

FIG. 173 shows the deduced amino acid sequence of white clover F3Ha cDNA (SEQ ID NO: 328).

FIG. 174 shows plasmid maps of sense and antisense constructs of TrF3Ha in pDH51 transformation vector.

FIG. 175 shows plasmid maps of sense and antisense constructs of TrF3Ha in pPZP221:35 S2 binary transformation vector.

Figure 176:
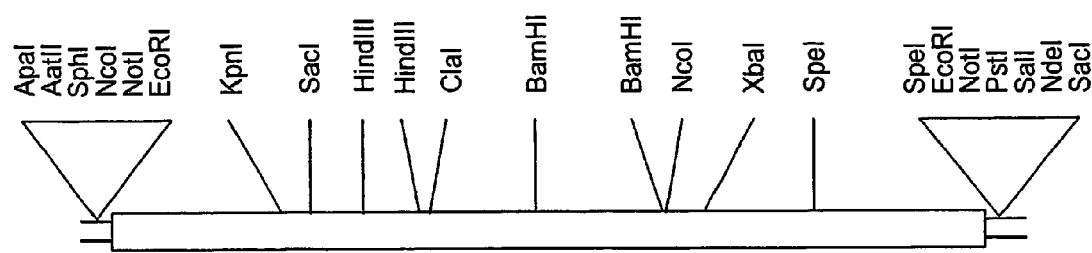

FIG. 176 shows a plasmid map of the cDNA encoding white clover PALa.

FIG. 177 shows the full nucleotide sequence of white clover PALa cDNA (SEQ ID NO: 329).

FIG. 178 shows the deduced amino acid sequence of white clover PALa cDNA (SEQ ID NO: 330).

FIG. 179 shows plasmid maps of sense and antisense constructs of TrPALa in pDH51 transformation vector.

Figure 180:
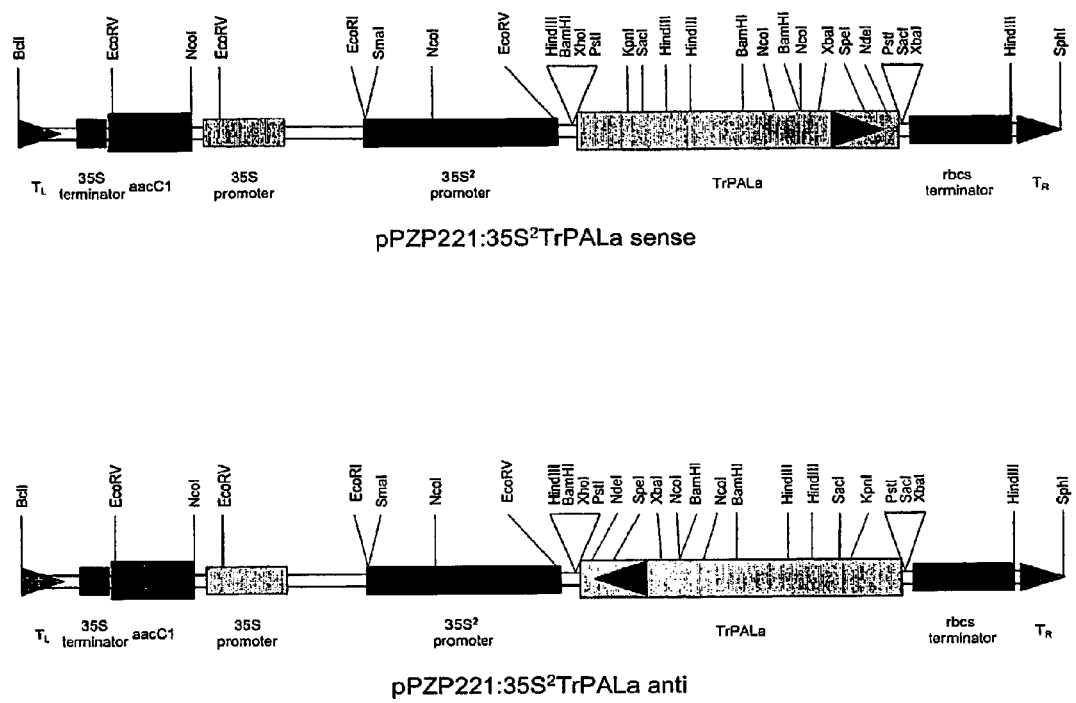

FIG. 180 shows plasmid maps of sense and antisense constructs of TrPALa in pPZP221:35 S2 binary transformation vector.

Figure 181:
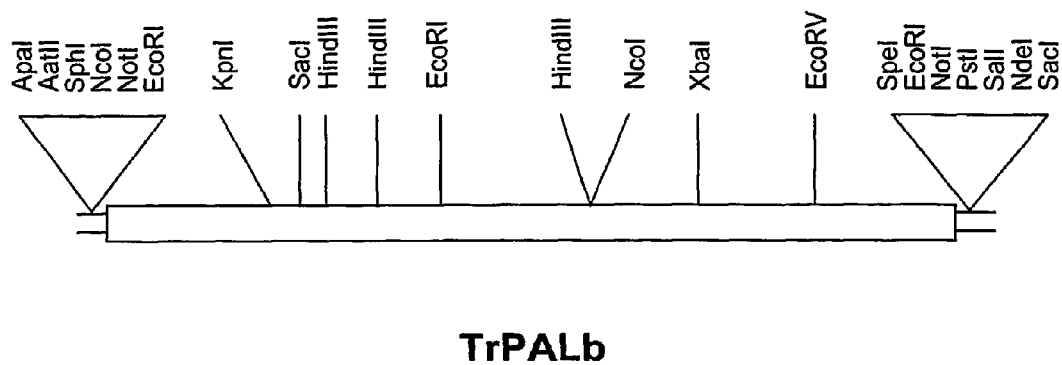

FIG. 181 shows a plasmid map of the cDNA encoding white clover PALb.

FIG. 182 shows the full nucleotide sequence of white clover PALb cDNA (SEQ ID NO: 331).

FIG. 183 shows the deduced amino acid sequence of white clover PALb cDNA (SEQ ID NO: 332).

FIG. 184 shows plasmid maps of sense and antisense constructs of TrPALb in pDH51 transformation vector.

FIG. 185 shows plasmid maps of sense and antisense constructs of TrPALb in pPZP221:35 S2 binary transformation vector.

Figure 186:
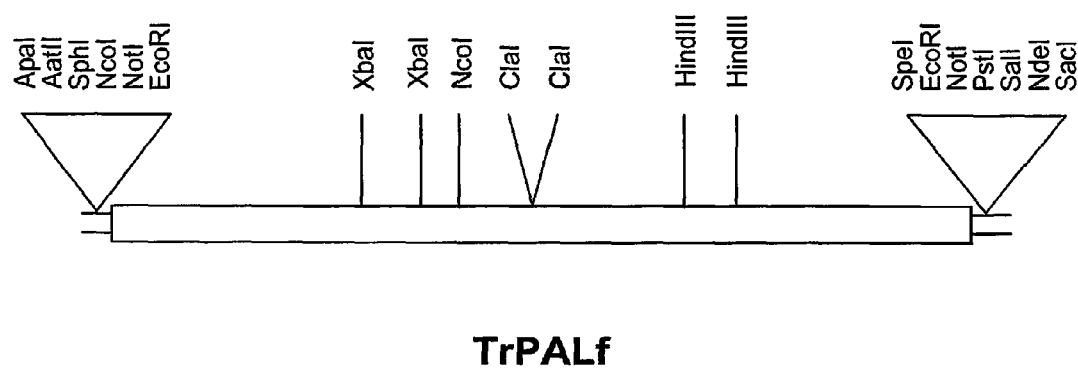

FIG. 186 shows a plasmid map of the cDNA encoding white clover PALf.

FIG. 187 shows the full nucleotide sequence of white clover PALf cDNA (SEQ ID NO: 333).

FIG. 188 shows the deduced amino acid sequence of white clover PALf cDNA (SEQ ID NO: 334).

FIG. 189 shows plasmid maps of sense and antisense constructs of TrPALf in pDH51 transformation vector.

FIG. 190 shows plasmid maps of sense and antisense constructs of TrPALf in pPZP221:35 S2 binary transformation vector.

Figure 191:
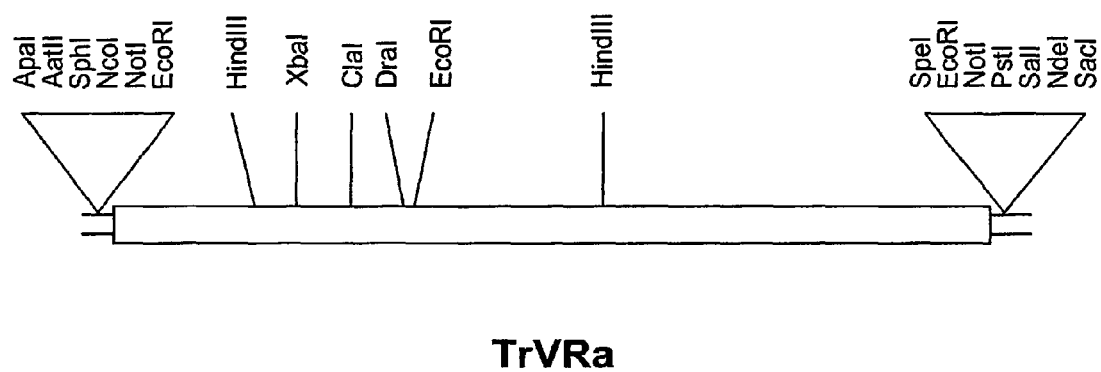

FIG. 191 shows a plasmid map of the cDNA encoding white clover VRa.

FIG. 192 shows the full nucleotide sequence of white clover VRa cDNA (SEQ ID NO: 335).

FIG. 193 shows the deduced amino acid sequence of white clover VRa cDNA (SEQ ID NO: 336).

FIG. 194 shows plasmid maps of sense and antisense constructs of TrVRa in pDH51 transformation vector.

FIG. 195 shows plasmid maps of sense and antisense constructs of TrVRa in pPZP221:35 S2 binary transformation vector.

FIG. 196 shows (A), infiltration of *Arabidopsis* plants; (B), selection of transgenic *Arabidopsis* plants on medium containing 75 μg/ml gentamycin; (C), young transgenic *Arabidopsis* plants; (D) and (E), two representative results of real-time PCR analysis of *Arabidopsis* transformed with chimeric genes involved in flavonoid biosynthesis.

Figure 197:
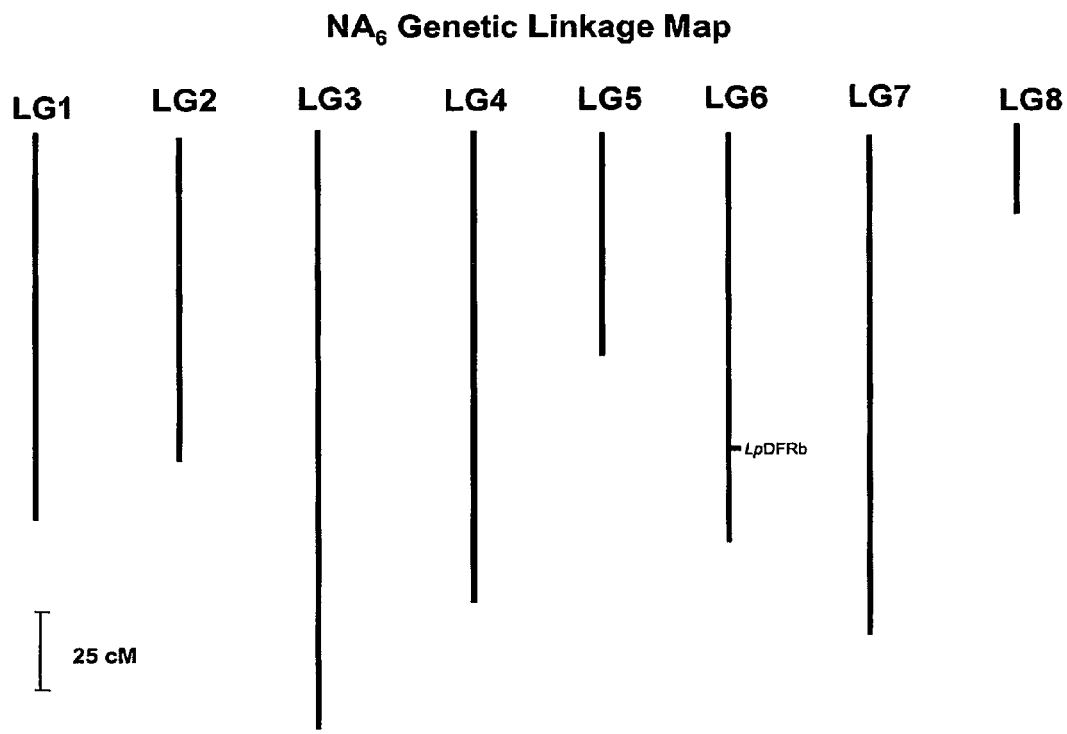

FIG. 197 shows the genetic map detailing the relation of perennial ryegrass genes involved in flavonoid biosynthesis.

DETAILED DESCRIPTION OF THE INVENTION

Example 1

Preparation of cDNA Libraries, Isolation and Sequencing of cDNAS Coding for CHI, CHI-Like, CHS, CHS-Like, CHR, CHR-Like, DFR, DFR-Like, LCR, LCR-Like, F3'5'H, F3'5'H-Like, F3H, F3H-Like, F3'H, F3'H-Like, PAL, PAL-Like, VR and VR-Like Proteins from White Clover (*Trifolium repens*) and Perennial Ryegrass (*Lolium perenne*)

cDNA libraries representing mRNAs from various organs and tissues of white clover (*Trifolium repens*) and perennial ryegrass (*Lolium perenne*) were prepared. The characteristics of the white clover and perennial ryegrass libraries, respectively, are described below (Tables 1 and 2).

TABLE 1 cDNA LIBRARIES FROM WHITE CLOVER (*Trifolium repens*)

| Library | Organ/Tissue |
|---|---|
| 01wc | Whole seedling, light grown |
| 02wc | Nodulated root 3, 5, 10, 14, 21 &28 day old seedling |
| 03wc | Nodules pinched off roots of 42 day old rhizobium inoculated plants |
| 04wc | Cut leaf and stem collected after 0, 1, 4, 6 &14 h after cutting |
| 05wc | Inflorescences: <50% open, not fully open and fully open |
| 06wc | Dark grown etiolated |
| 07wc | Inflorescence - very early stages, stem elongation, <15 petals, 15-20 petals |
| 08wc | seed frozen at −80° C., imbibed in dark overnight at 10° C. |
| 09wc | Drought stressed plants |
| 10wc | AMV infected leaf |
| 11wc | WCMV infected leaf |
| 12wc | Phosphorus starved plants |
| 13wc | Vegetative stolon tip |
| 14wc | stolon root initials |
| 15wc | Senescing stolon |
| 16wc | Senescing leaf |

TABLE 2 cDNA LIBRARIES FROM PERENNIAL RYEGRASS (*Lolium perenne*)

| Library | Organ/Tissue |
|---|---|
| 01rg | Roots from 3-4 day old light-grown seedlings |
| 02rg | Leaves from 3-4 day old light-grown seedlings |
| 03rg | Etiolated 3-4 day old dark-grown seedlings |
| 04rg | Whole etiolated seedlings (1-5 day old and 17 days old) |
| 05rg | Senescing leaves from mature plants |
| 06rg | Whole etiolated seedlings (1-5 day old and 17 days old) |
| 07rg | Roots from mature plants grown in hydroponic culture |
| 08rg | Senescent leaf tissue |
| 09rg | Whole tillers and sliced leaves (0, 1, 3, 6, 12 and 24 h after harvesting) |
| 10rg | Embryogenic suspension-cultured cells |
| 11rg | Non-embryogenic suspension-cultured cells |
| 12rg | Whole tillers and sliced leaves (0, 1, 3, 6, 12 and 24 h after harvesting) |
| 13rg | Shoot apices including vegetative apical meristems |
| 14rg | Immature inflorescences including different stages of inflorescence meristem and inflorescence development |
| 15rg | Defatted pollen |
| 16rg | Leaf blades and leaf sheaths (rbcL, rbcS, cab, wir2A subtracted) |
| 17rg | Senescing leaves and tillers |
| 18rg | Drought-stressed tillers (pseudostems from plants subjected to PEG-simulated drought stress) |
| 19rg | Non-embryogenic suspension-cultured cells subjected to osmotic stress (grown in media with half-strength salts) (1, 2, 3, 4, 5, 6, 24 and 48 h after transfer) |
| 20rg | Non-embryogenic suspension-cultured cells subjected to osmotic stress (grown in media with double-strength salts) (1, 2, 3, 4, 5, 6, 24 and 48 h after transfer) |
| 21rg | Drought-stressed tillers (pseudostems from plants subjected to PEG-simulated drought stress) |
| 22rg | Spikelets with open and maturing florets |
| 23rg | Mature roots (specific subtraction with leaf tissue) |

The cDNA libraries may be prepared by any of many methods available. For example, total RNA may be isolated using the TRIZOL method (Gibco-BRL; USA) or the RNEASY Plant Mini kit (Qiagen; Germany), following the manufacturers' instructions. cDNAs may be generated using the SMART PCR cDNA synthesis kit (Clontech; USA), cDNAs may be amplified by long distance polymerase chain reaction using the ADVANTAGE 2 PCR Enzyme system (Clontech; USA), cDNAs may be cleaned using the GENECLEAN spin column (Bio 101; USA), tailed and size fractionated, according to the protocol provided by Clontech. The cDNAs may be introduced into the pGEM-T Easy Vector system 1 (Promega; USA) according to the protocol provided by Promega. The cDNAs in the pGEM-T Easy plasmid vector are transfected into *Escherichia coli Epicurian coli* XL10-Gold ultra competent cells (Stratagene, USA) according to the protocol provided by Stratagene.

Alternatively, the cDNAs may be introduced into plasmid vectors for first preparing the cDNA libraries in Uni-ZAP XR vectors according to the manufacturer's protocol (Stratagene Cloning Systems; La Jolla, Calif., USA). The Uni-ZAP XR libraries are converted into plasmid libraries according to the protocol provided by Stratagene. Upon conversion, cDNA inserts will be contained in the plasmid vector pBluescript. In addition, the cDNAs may be introduced directly into precut pBluescript II SK(+) vectors (Stratagene) using T4 DNA ligase (New England Biolabs), followed by transfection into *E. coli* DH10B cells according to the manufacturer's protocol (GIBCO BRL Products).

Once the cDNA inserts are in plasmid vectors, plasmid DNAs were prepared from randomly picked bacterial colonies containing recombinant plasmids, or the insert cDNA sequences were amplified via polymerase chain reaction using primers specific for vector sequences flanking the inserted cDNA sequences. Plasmid DNA preparation was performed robotically using the Qiagen QiaPrep Turbo kit (Qiagen; Germany) according to the protocol provided by Qiagen. Amplified insert DNAs were sequenced in dye-terminator sequencing reactions to generate partial cDNA sequences (expressed sequence tags or "ESTs"). The resulting ESTs were analyzed using an Applied Biosystems ABI 3700 sequence analyser.

Example 2

DNA Sequence Analyses

The cDNA clones encoding CHI, CHI-like, CHS, CHS-like, CHR, CHR-like, DFR, DFR-like, LCR, LCR-like, F3'5'H, F3'5'H-like, F3H, F3H-like, F3'H, F3'H-like, PAL, PAL-like, VR and VR-like proteins were identified by conducting BLAST (Basic Local Alignment Search Tool; Altschul et al. (1993) *J. Mol. Biol.* 215:403-410) searches. The cDNA sequences obtained were analyzed for similarity to all publicly available DNA sequences contained in the eBioinformatics nucleotide database using the BLASTN algorithm provided by the National Center for Biotechnology Information (NCBI). The DNA sequences were translated in all reading frames and compared for similarity to all publicly available protein sequences contained in the SWISS-PROT protein sequence database using BLASTx algorithm (v 2.0.1) (Gish and States (1993) *Nature Genetics* 3:266-272) provided by the NCBI.

The cDNA sequences obtained and identified were then used to identify additional identical and/or overlapping cDNA sequences generated using the BLASTN algorithm. The identical and/or overlapping sequences were subjected to a multiple alignment using the CLUSTALw algorithm, and to generate a consensus contig sequence derived from this multiple sequence alignment. The consensus contig sequence was then used as a query for a search against the SWISS-PROT protein sequence database using the BLASTx algorithm to confirm the initial identification.

Example 3

Identification and Full-Length Sequencing of cDNAs Encoding Perennial Ryegrass F3OH and White Clover BANA, CHIA, CHID, CHRC, CHSA1, CHSA3, CHSC, CHSD2, CHSF, CHSH, DFRD, F3HA, PALA, PALB, PALF and VRA Proteins To fully characterize for the purposes of the generation of probes for hybridization experiments and the generation of transformation vectors, a set of cDNAs encoding perennial ryegrass F3OH and white clover BANa, CHIa, CHId, CHRc, CHSa1, CHSa3, CHSc, CHSd2, CHSf, CHSh, DFRd, F3Ha, PALa, PALb, PALf and VRa proteins was identified and fully sequenced.

Full-length cDNAs were identified from our EST sequence database using relevant published sequences (NCBI databank) as queries for BLAST searches. Full-length cDNAs were identified by alignment of the query and hit sequences using SEQUENCHER (Gene Codes Corp.; Ann Arbor, Mich.). The original plasmid was then used to transform chemically competent XL-1 cells (prepared in-house, $CaCl_2$ protocol). After colony PCR (using HotStarTaq, Qiagen), a minimum of three PCR-positive colonies per transformation were picked for initial sequencing with M13F and M13R primers. The resulting sequences were aligned with the original EST sequence using Sequencher to confirm the identity. One of the three clones having the best initial sequencing result was picked for full-length sequencing.

Sequencing was completed by primer walking, i.e. oligonucleotide primers were designed to the initial sequence and used for further sequencing. In most cases, the sequencing could be done from both 5' and 3' end. The sequences of the oligonucleotide primers are shown in Table 3. In some instances, however, an extended poly-A tail necessitated the sequencing of the cDNA to be completed from the 5' end.

Contigs were then assembled in Sequencher. The contigs include the sequences of the SMART primers used to generate the initial cDNA library as well as pGEM-T Easy vector sequence up to the EcoRI cut site both at the 5' and 3' end.

Plasmid maps and the full cDNA sequences of perennial ryegrass F3OH and white clover BANa, CHIa, CHId, CHRc, CHSa1, CHSa3, CHSc, CHSd2, CHSf, CHSh, DFRd, F3Ha, PALa, PALb, PALf and VRa proteins were obtained (FIGS. 110, 116, 121, 126, 131, 136, 141, 146, 151, 156, 161, 166, 171, 176, 181, 186 and 191).

TABLE 3

LIST OF PRIMERS USED FOR SEQUENCING OF THE FULL-LENGTH cDNAS

| GENE NAME | CLONE ID | SEQUENCING PRIMER | PRIMER SEQUENCE (5' > 3') | SEQ ID NO |
|---|---|---|---|---|
| LpF3OH | 08rg1YsF0708rg1YsF07.f1 | | TTGAGAGCTTCGTCGACC | 337 |
| | | 08rg1YsF07.r1 | AACTCCTCGTAGTACTCC | 338 |
| TrCHRc | 11wc1IsD0311wc1IsD03.f1 | | TTCAATTGGAGTACTTGG | 339 |
| | | 11wc1IsD03.r1 | ACTCCTTGTTCATATAACC | 340 |
| TrCHSa1 | 02wc2FsD0702wc2FsD07.f1 | | ACATGGTGGTGGTTGAGG | 341 |
| | | 02wc2FsD07.f2 | TGCTGCACTCATTGTTGG | 342 |
| | | 02wc2FsD07.f3 | ACATTGATAAGGCATTGG | 343 |
| TrCHSa3 | 05wc1RsB0605wc1RsB06.f1 | | AGGAGGCTGCAGTCAAGG | 344 |
| | | 05wc1RsB06.f2 | TGCCTGAAATTGAGAAACC | 345 |
| | | 05wc1RsB06.f3 | AAAGCTAGCCTTGAAGCC | 346 |
| TrCHSc | 07wc1TsE1207wc1TsE12.f1 | | TCGGACATAACTCATGTGG | 347 |
| | | 07wc1TsE12.f2 | TTGGGTTGGAGAATAAGG | 348 |

TABLE 3-continued

LIST OF PRIMERS USED FOR SEQUENCING OF THE FULL-LENGTH cDNAS

| GENE NAME | CLONE ID | SEQUENCING PRIMER | PRIMER SEQUENCE (5' > 3') | SEQ ID NO |
|---|---|---|---|---|
| | | 07wc1TsE12.r1 | TGGACATTTATTGGTTGC | 349 |
| | | 07wc1TsE12.r2 | TATCATGTCTGGAAATGC | 350 |
| TrCHSd2 | 07wc1XsD03 | 07wc1XsD03.f1 | TTTATGTGAGTACATGGC | 351 |
| | | 07wc1XsD03.f2 | AGCAGCTGTGATTGTAGG | 352 |
| | | 07wc1XsD03.f3 | TGAGAAAGCTCTTGTTGAGG | 353 |
| TrCHSf | 07wc1UsD07 | 07wc1UsD07.f1 | AGATTGCATCAAAGAATGG | 354 |
| | | 07wc1UsD07.r1 | GGTCCAAAAGCCAATCC | 355 |
| TrCHSh | 13wc2IsG04 | 13wc2IsG04.f1 | TAAGACGAGACATAGTGG | 356 |
| | | 13wc2IsG04.r1 | TATTCACTAAGCACATGC | 357 |
| TrDFRd | 12wc1CsE09 | 12wc1CsE09.f1 | TTACCTCGTCTGTCTCG | 358 |
| | | 12wc1CsE09.r1 | AACACACACATGTCTACC | 359 |
| TrF3Ha | 07wc1LsG03 | 07wc1LsG03.f1 | TGAAGGATTGGAGAGAGC | 360 |
| | | 07wc1LsG03.r1 | TACACAGTTGCATCTGG | 361 |
| TrPALa | 04wc1UsB03 | 04wc1UsB03.f1 | ATCGGAATCTGCTAGAGC | 362 |
| | | 04wc1UsB03.f2 | TGTTGGTTCTGGTTTAGC | 363 |
| | | 04wc1UsB03.r1 | TTCATATGCAATCCTTGC | 364 |
| | | 04wc1UsB03.r2 | TCTTGGTTGTGTTGTTCC | 365 |
| TrPALb | 05wc1PsH02 | 05wc1PsH02.f1 | TGGGACTGATAGTTATGG | 366 |
| | | 05wc1PsH02.f2 | TCTTGCTCTTGTTAATGG | 367 |
| | | 05wc1PsH02.r1 | AGCACCATTCCACTCTCC | 368 |
| | | 05wc1PsH02.r2 | TTCTCTTCGCTACTTGGC | 369 |
| TrPALf | 13wc2AsD12 | 13wc2AsD12.f1 | ATAGTGGTGTGAGGGTGG | 370 |
| | | 13wc2AsD12.f2 | TCTTGTTAATGGTACTGC | 371 |
| | | 13wc2AsD12.r1 | ATTTATCGCACTCTTCGC | 372 |
| | | 13wc2AsD12.r2 | AAAGTGGAAGACATGAGC | 373 |
| TrVRa | 11wc1NsA07 | 11wc1NsA07.f1 | AAGAACAGTGGATGGAGC | 374 |
| | | 11wc1NsA07.r1 | TCAACTCATCTACTGATAG | 375 |

Example 4

Development of Transformation Vectors Containing Chimeric Genes with cDNA Sequences from Perennial Ryegrass F3OH and White Clover BANA, CHIA, CHID, CHRC, CHSA1, CHSA3, CHSC, CHSD2, CHSF, CHSH, DFRD, F3HA, PALA, PALB, PALF and VRA To alter the expression of the proteins involved in flavonoid biosynthesis, protein binding, metal chelation, anti-oxidation, UV-light absorption, tolerance to biotic stresses such as viruses, micro-organisms, insects and fungal pathogens; pigmentation in for example flowers and leaves; herbage quality and bloat-safety and isoflavonoid content leading to health benefits, perennial ryegrass F3OH and white clover BANa, CHIa, CHId, CHRc, CHSa1, CHSa3, CHSc, CHSd2, CHSf, CHSh, DFRd, F3Ha, PALa, PALb, PALf and VRa, through antisense and/or sense suppression technology and for overexpression of these key enzymes in transgenic plants, a set of sense and antisense transformation vectors was produced.

cDNA fragments were generated by high fidelity PCR using the original pGEM-T Easy plasmid cDNA as a template. The primers used (Table 4) contained recognition sites for appropriate restriction enzymes, for example EcoRI and XbaI, for directional and non-directional cloning into the target vector. After PCR amplification and restriction digest with the appropriate restriction enzyme (usually XbaI), the cDNA fragments were cloned into the corresponding site in pDH51, a pUC18-based transformation vector containing a CaMV 35S expression cassette. The orientation of the constructs (sense or antisense) was checked by DNA sequencing through the multi-cloning site of the vector. Transformation vectors containing chimeric genes using full-length open reading frame cDNAs encoding perennial ryegrass F3OH and white clover BANa, CHIa, CHId, CHRc, CHSa1, CHSa3, CHSc, CHSd2, CHSf, CHSh, DFRd, F3Ha, PALa, PALb, PALf and VRa proteins in sense and antisense orientations under the control of the CaMV 35S promoter were generated (FIGS. 113, 119, 124, 129, 134, 139, 144, 149, 154, 159, 164, 169, 174, 179, 184, 189 and 194).

TABLE 4

LIST OF PRIMERS USED TO PCR-AMPLIFY THE OPEN READING FRAMES

| GENE NAME | CLONE ID | PRIMER | PRIMER SEQUENCE (5' > 3') | SEQ ID NO |
|---|---|---|---|---|
| LpF3OH | 08rl1YsF07 | 08rg1YsF07f | GAATTCTAGAAGCAGAAAGTACGGACATCAGC | 376 |
| | | 08rg1YsF07r | GAATTCTAGAACCATATGGCGACACATCG | 377 |

TABLE 4-continued

LIST OF PRIMERS USED TO PCR-AMPLIFY THE OPEN READING FRAMES

| GENE NAME | CLONE ID | PRIMER | PRIMER SEQUENCE (5' > 3') | SEQ ID NO |
|---|---|---|---|---|
| TrBANa | 05wc2XsG02 | 05wc2XsG02f | GGATCCTCTAGAGCACTAGTGTG-TATAAGTTTCTTGG | 378 |
|  |  | 05wc2XsG02r | GGATCCTCTAGACCCCCTTAGTCTTAAAATACTCG | 379 |
| TrCHIa | 06wc2AsF12 | 06wc2AsF12f | GAATTCTAGAGATCTGAAACAACATAGTCACC | 380 |
|  |  | 06wc2AsF12r | GAATTCTAGATCAATCTTGTGCTGCAATGC | 381 |
| TrCHId | 12wc1FsG04 | 12wc1FsG04f | GAATTCTAGAAAGTTCAACGAGATCAATGG | 382 |
|  |  | 12wc1FsG04r | GAATTCTAGATTCCGCTTGGTCTTTATTGC | 383 |
| TrCHRc | 11wc1IsD03 | 11wc1IsD03f | GAATTCTAGAACATGGGTAGTGTTGAAATTCC | 384 |
|  |  | 11wc1IsD03r | GAATTCTAGAAGATATTGAGTGAGCTTAAGG | 385 |
| TrCHSa1 | 02wc2FsD07 | 02wc2FsD07f | GACGTCGACATTACATACATAGCAGGAAC | 386 |
|  |  | 02wc2FsD07r | GACGTCGACAGTCTCTCATTCTCATATAGC | 387 |
| TrCHSa3 | 05wc1RsB06 | 05wc1RsB06f | GAATTCTAGAAGATATGGTGAGTGTAGCTG | 388 |
|  |  | 05wc1RsB06r | GAATTCTAGAATCACACATCTTATATAGCC | 389 |
| TrCHSc | 07wc1TsE12 | 07wc1TsE12f | GAATTCTAGAAGAAGAAATATGGGAGACGAAGG | 390 |
|  |  | 07wc1TsE12r | GAATTCTAGAAAGACTTCATGCACACAAGTTCC | 391 |
| TrCHSd2 | 07wc1XsD03 | 07wc1XsD03f | GAATTCTAGAATAACCTATCAGTACTCACC | 392 |
|  |  | 07wc1XsD03r | GAATTCTAGAATCTAGGCAATTTAAGTGGC | 393 |
| TrCHSf | 07wc1UsD07 | 07wc1UsD07f | GAATTCTAGATGATTCATTGTTTGTTTCCATAAC | 394 |
|  |  | 07wc1UsD07r | GAATT CTAGAACATATTCATCTTCCTATCAC | 395 |
| TrCHSh | 13wc2IsG04 | 13wc2IsG04f | GAATTCTAGATCCAAATTCTCGTACCTCACC | 396 |
|  |  | 13wc2IsG04r | GAATTCTAGATAGTTCACATCTCTCGGCAGG | 397 |
| TrDFRd | 12wc1CsE09 | 12wc1CsE09f | GACGTCGACACAACAGTCTTCCACTTGAGC | 398 |
|  |  | 12wc1CsE09r | GACGTCGACTCTATACTCTGGTAACTATAGG | 399 |
| TrF3Ha | 07wc1LsG03 | 07wc1LsG03f | GAATTCTAGAACCACACAACACACAAACACC | 400 |
|  |  | 07wc1LsG03r | GAATTCTAGAACCAAGCAGCTTAATACACG | 401 |
| TrPALa | 04wc1UsB03 | 04wc1UsB03f | AGTACTGCAGAGATATGGAAGTAGTAGCAGCAGC | 402 |
|  |  | 04wc1UsB03r | AGTACTGCAGTAGCAAACCAGTTCCCAACTCC | 403 |
| TrPALb | 05wc1PsH02 | 05wc1PsH02f | AGTACTGCAGATAATGGAGGGAATTACCAATGG | 404 |
|  |  | 05wc1PsH02r | AGTACTGCAGTGCTAATTAACATATTGGTAGAGG | 405 |
| TrPALf | 13wc2AsD12 | 13wc2AsD12f | AGTACTGCAGATAATGGAGGGAATTACCAATGG | 406 |
|  |  | 13wc2AsD12r | AGTACTGCAGTGCTAATTAACATATTGGTAGAGG | 407 |
| TrVRa | 11wc1NsA07 | 11wc1NsA07f | AGTACTGCAGATAAAGAGAGTCAAAAATGGC | 408 |
|  |  | 11wc1NsA07r | AGTACTGCAGAACACATACTTAGAGATAGCC | 409 |

Example 5

Development of Binary Transformation Vectors Containing Chimeric Genes with cDNA Sequences from Perennial Ryegrass F3OH and White Clover BANA, CHIA, CHID, CHRC, CHSA1, CHSA3, CHSC, CHSD2, CHSF, CHSH, DFRD, F3HA, PALA, PALB, PALF and VRA To alter the expression of the proteins involved in flavonoid biosynthesis, protein binding, metal chelation, anti-oxidation, UV-light absorption, tolerance to biotic stresses such as viruses, micro-organisms, insects and fungal pathogens; pigmentation in for example flowers and leaves; herbage quality and bloat-safety and isoflavonoid content leading to health benefits, perennial ryegrass F3OH and white clover BANa, CHIa, CHId, CHRc, CHSa1, CHSa3, CHSc, CHSd2, CHSf, CHSh, DFRd, F3Ha, PALa, PALb, PALf and VRa, through antisense and/or sense suppression technology and for over-expression of these key proteins in transgenic plants, a set of sense and antisense binary transformation vectors was produced.

cDNA fragments were generated by high fidelity PCR using the original pGEM-T Easy plasmid cDNA as a template. The primers used (Table 4) contained recognition sites for appropriate restriction enzymes, for example EcoRI and XbaI, for directional and non-directional cloning into the target vector. After PCR amplification and restriction digest with the appropriate restriction enzyme (usually XbaI), the cDNA fragments were cloned into the corresponding site in a modified pPZP binary vector (Hajdukiewicz et al., 1994). The pPZP221 vector was modified to contain the 35S2 cassette from pKYLX71:35 S2 as follows. pKYLX71:35 S2 was cut with ClaI. The 5' overhang was filled in using Klenow and the blunt end was A-tailed with Taq polymerase. After cutting with EcoRI, the 2 kb fragment with an EcoRI-compatible and a 3'-A tail was gel-purified. pPZP221 was cut with HindIII and the resulting 5' overhang filled in and T-tailed with Taq polymerase. The remainder of the original pPZP221 multi-cloning site was removed by digestion with EcoRI, and the expression cassette cloned into the EcoRI site and the 3' T overhang restoring the HindIII site. This binary vector contains between the left and right border the plant selectable marker gene aaaC1 under the control of the 35S promoter and 35S terminator and the pKYLX71:35 S2-derived expression cassette with a CaMV 35S promoter with a duplicated enhancer region and an rbcS terminator.

The orientation of the constructs (sense or antisense) was checked by restriction enzyme digest. Transformation vectors containing chimeric genes using full-length open reading frame cDNAs encoding perennial ryegrass F3OH and white clover BANa, CHIa, CHId, CHRc, CHSa1, CHSa3, CHSc, CHSd2, CHSf, CHSh, DFRd, F3Ha, PALa, PALb, PALf and VRa proteins in sense and antisense orientations under the control of the CaMV 3552 promoter were generated (FIGS. 114, 120, 125, 130, 135, 140, 145, 150, 155, 160, 165, 170, 175, 180, 185, 190 and 195).

Example 6

Production and Analysis of Transgenic *Arabidopsis* Plants Carrying Chimeric Perennial Ryegrass F3OH and White Clover BANA, CHIA, CHID, CHRC, CHSA1, CHSA3, CHSC, CHSD2, CHSF, CHSH, DFRD, F3HA, PALA, PALB, PALF and VRA Genes Involved in Flavonoid Biosynthesis A set of transgenic *Arabidopsis* plants carrying chimeric perennial ryegrass and white clover genes involved in flavonoid biosynthesis, protein binding, metal chelation, anti-oxidation, UV-light absorption, tolerance to biotic stresses such as viruses, micro-organisms, insects and fungal pathogens; pigmentation in for example flowers and leaves; herbage quality and bloat-safety and isoflavonoid content leading to health benefits, were produced.

pPZP221-based transformation vectors with LpF3OH and TrBANa, TrCHIa, TrCHId, TrCHRc, TrCHSa1, TrCHSa3, TrCHSc, TrCHSd2, TrCHSf, TrCHSh, TrDFRd, TrF3Ha, TrPALa, TrPALb, TrPALf and TrVRa cDNAs comprising the full open reading frame sequences in sense and antisense orientations under the control of the CaMV 35S promoter with duplicated enhancer region (35S2) were generated as detailed in Example 6.

*Agrobacterium*-mediated gene transfer experiments were performed using these transformation vectors.

The production of transgenic *Arabidopsis* plants carrying the perennial ryegrass F3OH and white clover BANa, CHIa, CHId, CHRc, CHSa1, CHSa3, CHSc, CHSd2, CHSf, CHSh, DFRd, F3Ha, PALa, PALb, PALf and VRa cDNAs under the control of the CaMV 35S promoter with duplicated enhancer region (35S2) is described here in detail.
Preparation of *Arabidopsis* Plants Seedling punnets were filled with Debco seed raising mixture (Debco Pty. Ltd.) to form a mound. The mound was covered with two layers of anti-bird netting secured with rubber bands on each side. The soil was saturated with water and enough seeds (*Arabidopsis thaliana* ecotype Columbia, Lehle Seeds #WT-02) sown to obtain approximately 15 plants per punnet. The seeds were then vernalised by placing the punnets at 4° C. After 48 hours the punnets were transferred to a growth room at 22° C. under fluorescent light (constant illumination, 55 μmolm-2s-1) and fed with Miracle-Gro (Scotts Australia Pty. Ltd.) once a week. Primary bolts were removed as soon as they appeared. After 4-6 days the secondary bolts were approximately 6 cm tall, and the plants were ready for vacuum infiltration.
Preparation of *Agrobacterium*

*Agrobacterium tumefaciens* strain AGL-1 were streaked on LB medium containing 50 μg/ml rifampicin and 50 μg/ml kanamycin and grown at 27° C. for 48 hours. A single colony was used to inoculate 5 ml of LB medium containing 50 μg/ml rifampicin and 50 μg/ml kanamycin and grown over night at 27° C. and 250 rpm on an orbital shaker. The overnight culture was used as an inoculum for 500 ml of LB medium containing 50 μg/ml kanamycin only. Incubation was over night at 27° C. and 250 rpm on an orbital shaker in a 2 l Erlenmeyer flask.

The overnight cultures were centrifuged for 15 min at 5500×g and the supernatant discarded. The cells were resuspended in 1 l of infiltration medium [5% (w/v) sucrose, 0.03% (v/v) Silwet-L77 (Vac-In-Stuff, Lehle Seeds #VIS-01)] and immediately used for infiltration.
Vacuum Infiltration The *Agrobacterium* suspension was poured into a container (Décor Tellfresh storer, #024) and the container placed inside the vacuum desiccator (Bel Art, #42020-0000). A punnet with *Arabidopsis* plants was inverted and dipped into the *Agrobacterium* suspension and a gentle vacuum (250 mm Hg) was applied for 2 min. After infiltration, the plants were returned to the growth room where they were kept away from direct light overnight. The next day the plants were returned to full direct light and allowed to grow until the siliques were fully developed. The plants were then allowed to dry out, the seed collected from the siliques and either stored at room temperature in a dry container or used for selection of transformants.
Selection of Transformants Prior to plating the seeds were sterilized as follows. Sufficient seeds for one 150 mm petri dish (approximately 40 mg or 2000 seeds) were placed in a 1.5 ml microfuge tube. Five hundred microliters (500 μl) 70% ethanol were added for 2 min and replaced by 500 μl sterilization solution (H2O:4% chlorine:5% SDS, 15:8:1). After vigorous shaking, the tube was left for 10 min after which time the sterilization solution was replaced with 500 μl sterile water. The tube was shaken and spun for 5 sec to sediment the seeds. The washing step was repeated 3 times and the seeds were left covered with approximately 200 μl sterile water.

The seeds were then evenly spread on 150 mm petri dishes containing germination medium (4.61 g Murashige & Skoog salts, 10 g sucrose, 1 ml 1 M KOH, 2 g Phytagel, 0.5 g MES and 1 ml 1000× Gamborg's B-5 vitamins per litre) supplemented with 250 μg/ml timetin and 75 μg/ml gentamycin. After vernalisation for 48 hours at 4° C. the plants were grown under continuous fluorescent light (55 μmol m-2s-1) at 22° C. to the 6-8 leaf stage and transferred to soil.
Preparation of Genomic DNA Three to four leaves of *Arabidopsis* plants regenerated on selective medium were harvested and freeze-dried. The tissue was homogenized on a Retsch MM300 mixer mill, then centrifuged for 10 min at 1700×g to collect cell debris. Genomic DNA was isolated from the supernatant using Wizard Magnetic 96 DNA Plant System kits (Promega) on a Biomek FX (Beckman Coulter). 5 μl of the sample (50 μl) were then analyzed on an agarose gel to check the yield and the quality of the genomic DNA.
Analysis of DNA Using Real-Time PCR Genomic DNA was analyzed for the presence of the transgene by real-time PCR using SYBR Green chemistry. PCR primer pairs (Table 5) were designed using MacVector (Accelrys). The forward primer was located within the 35S2 promoter region and the reverse primer within the transgene to amplify products of approximately 150-250 bp as recommended. The positioning of the forward primer within the 35S2 promoter region guaranteed that homologous genes in *Arabidopsis* were not detected.

5 μl of each genomic DNA sample was run in a 50 μl PCR reaction including SYBR Green on an ABI (Applied Biosystems) together with samples containing DNA isolated from wild type *Arabidopsis* plants (negative control), samples containing buffer instead of DNA (buffer control) and samples containing the plasmid used for transformation (positive plasmid control).

Plants were obtained after transformation with all chimeric constructs and selection on medium containing gentamycin. The selection process and two representative real-time PCR analyses are shown in FIG. 196.

TABLE 5

LIST OF PRIMERS USED FOR REAL-TIME PCR ANALYSIS OF ARABIDOPSIS PLANTS TRANSFORMED WITH CHIMERIC PERENNIAL RYEGRASS GENES INVOLVED IN FLAVONOID BIOSYNTHESIS

| CONSTRUCT | PRIMER 1 (FORWARD) | SEQ ID NO | PRIMER 2 (REVERSE) | SEQ ID NO |
|---|---|---|---|---|
| pPZP221LpF3OH sense | TTGGAGAGGACACGCTGAAATC | 410 | AGGAGAGGGTTGGACATCGC | 411 |
| pPZP221LpF3OH anti | CATTTCATTTGGAGAGGACACGC | 412 | ACGAGGAGTTCTGGAAGATGGG | 413 |
| pPZP221TrBANa sense | TTGGAGAGGACACGCTGAAATC | 414 | GCAACAAAACCAGTGCCACC | 415 |
| pPZP221TrBANa anti | TCATTTGGAGAGGACACGCTG | 416 | GATGATTGCCCCAGCAAGG | 417 |
| pPZP221TrCHIa sense | CATTTCATTTGGAGAGGACACGC | 418 | CAAGGTTCTCGACTTGGATTGC | 419 |
| pPZP221TrCHIa anti | TCATTTGGAGAGGACACGCTG | 420 | AGATTACCTGCCTTGTTGAACGAG | 421 |
| pPZP221TrCHId sense | TCATTTGGAGAGGACACGCTG | 422 | GACGGTAGGAGGGAATAGATTGTTC | 423 |
| pPZP221TrCHId anti | TCATTTGGAGAGGACACGCTG | 424 | CCAGGTTATCCGAGTTATTCAACG | 425 |
| pPZP221TrCHRc sense | CCACTATCCTTCGCAAGACCC | 426 | TCCCATTCCAACCACAGGC | 427 |
| pPZP221TrCHRe anti | TCATTTGGAGAGGACACGCTG | 428 | CAAGCCAGGACTCAGTGACCTATG | 429 |
| pPZP221TrCHSa1 sense | TCATTTGGAGAGGACACGCTG | 430 | CTGGTCAACACGATTTGCTGG | 431 |
| pPZP221TrCHSa1 anti | TCATTTGGAGAGGACACGCTG | 432 | AACCACAGGAGAAGGACTTGACTG | 433 |
| pPZP221TrCHSa3 sense | CATTTCATTTGGAGAGGACACGC | 434 | AACACGGTTTGGTGGATTTGC | 435 |
| pPZP221TrCHSa3 anti | TCATTTGGAGAGGACACGCTG | 436 | ACAACTGGAGAAGGACTTGATTGG | 437 |
| pPZP221TrCHSc sense | TTGGAGAGGACACGCTGAAATC | 438 | ACAAGTTGGTGAGGGAATGCC | 439 |
| pPZP221TrCHSc anti | TCATTTGGAGAGGACACGCTG | 440 | GGGATTGATACTTGCTTTTGGACC | 441 |
| pPZP221TrCHSd2 sense | CCCACTATCCTTCGCAAGACC | 442 | AGTTGCAGTGCCGATTGCC | 443 |
| pPZP221TrCHSd2 anti | CATTTCATTTGGAGAGGACACGC | 444 | AAGATGGACTTGCCACAACAGG | 445 |
| pPZP221TrCHSf sense | CATTTCATTTGGAGAGGACACGC | 446 | TCGTTGCCTTTCCCTGAGTAGG | 447 |
| pPZP221TrCHSf anti | TCATTTGGAGAGGACACGCTG | 448 | GATTGGCTTTTGGACCAGGG | 449 |

TABLE 5-continued

LIST OF PRIMERS USED FOR REAL-TIME PCR ANALYSIS OF ARABIDOPSIS PLANTS TRANSFORMED WITH CHIMERIC PERENNIAL RYEGRASS GENES INVOLVED IN FLAVONOID BIOSYNTHESIS

| CONSTRUCT | PRIMER 1 (FORWARD) | SEQ ID NO | PRIMER 2 (REVERSE) | SEQ ID NO |
|---|---|---|---|---|
| pPZP221TrCHSh sense | TCATTTGGAGAGG ACACGCTG | 450 | CGGTCACCATTTTTT GTTGGAGG | 451 |
| pPZP221TrCHSh anti | TCATTTGGAGAGG ACACGCTG | 452 | TGTTGTTTGGGTTTGG ACCG | 453 |
| pPZP221TrDFRd sense | CATTTCATTTGGA GAGGACACGC | 454 | ATTGAGATTTTGGACG GTGGC | 455 |
| pPZP221TrDFRd anti | CATTTCATTTGGA GAGGACACGC | 456 | CGCAACCTGGATTGTT GAGAGC | 457 |
| pPZP221TrF3Ha sense | TCATTTGGAGAGG ACACGCTG | 458 | TCTTCCCTAACGAAAC TTGACTCG | 459 |
| pPZP221TrF3Ha anti | TCATTTGGAGAGG ACACGCTG | 460 | GAACAACAACTTAGGG ACTTGGAGG | 461 |
| pPZP221TrPALa sense | ATGACGCACAATC CCACTATCC | 462 | TTGCCTCAGCAGCCAC ACC | 463 |
| pPZP221TrPALa anti | GGAGAGGACACGC TGAAATCAC | 464 | TGCCAAAAGAGGTTGA AAGTGC | 465 |
| pPZP221TrPALb sense | ATCCCACTATCCT TCGCAAGACCC | 466 | AATGACTCCCCATCAA CGACTCCG | 467 |
| pPZP221TrPALb anti | TTGGAGAGGACAC GCTGAAATCC | 468 | GACAAATTGTTCACAG CTATGTGC | 469 |
| pPZP221TrPALf sense | ATCCCACTATCCT TCGCAAGACCC | 470 | CACCATACGCTTCACC TCATCC | 471 |
| pPZP221TrPALf anti | TCATTTGGAGAGG ACACGCTG | 472 | TTGTTAGAGAGGAGTT AGGAACCGC | 473 |
| pPZP221TrVRa sense | CCACTATCCTTCG CAAGACCC | 474 | GCTTACATCCCTCTTA CGTTCTGG | 475 |
| pPZP221TrVRa anti | CCACTATCCTTCG CAAGACCC | 476 | AAAAGCTCGTGGACGC TGG | 477 |

Example 7

Genetic Mapping of Perennial Ryegrass Genes Involved in Flavonoid Biosynthesis, Protein Binding, Metal Chelation, Anti-Oxidation, UV-Light Absorption, Tolerance to Biotic Stresses such as Viruses, Micro-Organisms, Insects and Fungal Pathogens; Pigmentation in for Example Flowers and Leaves; Herbage Quality and Bloat-Safety and Isoflavonoid Content Leading to Health Benefits The cDNAs representing genes involved in flavonoid biosynthesis, protein binding, metal chelation, anti-oxidation, UV-light absorption, tolerance to biotic stresses such as viruses, micro-organisms, insects and fungal pathogens; pigmentation in for example flowers and leaves; herbage quality and bloat-safety and isoflavonoid content leading to health benefits, were amplified by PCR from their respective plasmids, gel-purified and radio-labelled for use as probes to detect restriction fragment length polymorphisms (RFLPs). RFLPs were mapped in the F1 (first generation) population, NA6×AU6. This population was made by crossing an individual (NA6) from a North African ecotype with an individual (AU6) from the cultivar Aurora, which is derived from a Swiss ecotype. Genomic DNA of the 2 parents and 114 progeny was extracted using the 1×CTAB method of Fulton et al. (1995).

Probes were screened for their ability to detect polymorphism using the DNA (10 μg) of both parents and 5 F1 progeny restricted with the enzymes DraI, EcoRI, EcoRV or HindIII. Hybridizations were carried out using the method of Sharp et al. (1988). Polymorphic probes were screened on a progeny set of 114 individuals restricted with the appropriate enzyme (FIG. 115).

RFLP bands segregating within the population were scored and the data were entered into an Excel spreadsheet. Alleles showing the expected 1:1 ratio were mapped using MAP-MAKER 3.0 (Lander et al. 1987). Alleles segregating from, and unique to, each parent, were mapped separately to give two different linkage maps. Markers were grouped into linkage groups at a LOD of 5.0 and ordered within each linkage group using a LOD threshold of 2.0.

Loci representing genes involved in flavonoid biosynthesis mapped to the linkage groups as indicated in Table 6 and in FIG. 197. These gene locations can now be used as candidate genes for quantitative trait loci associated with flavonoid biosynthesis, protein binding, metal chelation, anti-oxidation, UV-light absorption, tolerance to biotic stresses such as viruses, micro-organisms, insects and fungal pathogens; pigmentation in for example flowers and leaves; herbage quality and bloat-safety and isoflavonoid content leading to health benefits.

TABLE 6

MAP LOCATIONS OF RYEGRASS GENES INVOLVED IN FLAVONOID BIOSYNTHESIS ACROSS TWO GENETIC LINKAGE MAPS OF PERENNIAL RYEGRASS

| Probe | Polymorphic | Mapped with | Locus | Linkage group NA6 | → AU6 |
|---|---|---|---|---|---|
| LpDFRb | Y | Hind III | LpDFRb | 6 | 6 |

Finally, it is to be understood that various alterations, modifications and/or additions may be made without departing from the spirit of the present invention as outlined herein.

It will also be understood that the term "comprises" (or its grammatical variants) as used in this specification is equivalent to the term "includes" and should not be taken as excluding the presence of other elements or features.

Documents cited in this specification are for reference purposes only and their inclusion is not acknowledgment that they form part of the common general knowledge in the relevant art.

REFERENCES

An, G., Watson, B. D., Stachel, S., Gordon, M. P., Nester, E. W. (1985) "New cloning vehicles for transformation of higher plants". *The EMBO Journal* 4, 227-284.

Feinberg, A. P., Vogelstein, B. (1984). "A technique for radiolabelling DNA restriction endonuclease fragments to high specific activity". *Anal. Biochem,* 132: 6-13.

Frohman et al. (1988) "Rapid production of full-length cDNAs from rare transcripts: amplification using a single gene-specific oligonucleotide primer". *Proc. Natl. Acad Sci. USA* 85:8998.

Gish and States (1993) "Identification of protein coding regions by database similarity search". *Nature Genetics* 3:266-272.

Lander, E. S., Green P., Abrahamson, J., Barlow, A., Daly, M. J., Lincoln, S. E., Newburg, L. (1987). "MAPMAKER: an interactive computer package for constructing primary linkage maps of experimental and natural populations". *Genomics* 1: 174-181.

Loh, E. Y., Elliott, J. F., Cwirla, S., Lanier, L. L., Davis, M. M. (1989). "Polymerase chain reaction with single-sided specificity: Analysis of T-cell receptor delta chain". *Science* 243:217-220.

Ohara, O., Dorit, R. L., Gilbert, W. (1989). "One-sided polymerase chain reaction: The amplification of cDNA". *Proc. Natl. Acad Sci USA* 86:5673-5677.

Sambrook, J., Fritsch, E. F., Maniatis, T. (1989). *Molecular Cloning. A Laboratory Manual.* Cold Spring Harbour Laboratory Press.

Schardl, C. L., Byrd, A. D., Benzion, G., Altschuler, M. A., Hildebrand, D. F., Hunt, A. G. (1987) "Design and construction of a versatile system for the expression of foreign genes in plants". *Gene* 61, 1-11.

Sharp, P. J., Kreis, M., Shewry, P. R., Gale, M. D. (1988). "Location of α-amylase sequences in wheat and its relatives". *Theor. Appl. Genet.* 75:286-290.

SEQUENCE LISTING (477 sequences)

SEQ ID NO: 1 - DNA, 636 bp, Trifolium repens
  misc_feature (11)..(11): Any nucleotide
  misc_feature (17)..(17): Any nucleotide
gcattaaacantgaaanttgaccagtcccaacaaagatctgaaacacatagctccccattttttaacattaaactaaaaatatgtcggccatcaccgcaatccaagtcgagaaccttgaatttccggctgtgattacttctccggccaccggtaagtcatattttcttggtggtgcaggggagagaggtttgactattgaaggaaacttcatcaagttcactgccataggagtatatttggaagatgtagcagtggcttcacttgccactaaatggaagggcaaatcctctgaagagttgcttgagacccttgacttctacagagatatcatttcaggaccatttgagaagttgattcgaggatcgaagattagggaattgagtggtcctgagtactcaaggaaggttaatgaaaactgtgtggcacacttaaaatctgttgggacttatggagatgcagaagttgaagctatgcaaaaatttgttgaagccttcaagcctattaattttccacctggtgcctctgttttttacaggcaatcacctgatggaatattagggcttagtttctctcaagatgcaagtataccagaaaaggaagctgcagtaatagagaacaagggagcttcatcggcg

SEQ ID NO: 2 - protein, 185 aa, Trifolium repens
MSAITAIQVENLEFPAVITSPATGKSYFLGGAGERGLTIEGNFIKFTAIGVYLEDVAVASLATKWKGKSSEELLETLDFYRDIISGPFEKLIRGSKIRELSGPEYSRKVNENCVAHLKSVGTYGDAEVEAMQKFVEAFKPINFPPGASVFYRQSPDGILGLSFSQDASIPEKEAAVIENKGASSA

SEQ ID NO: 3 - DNA, 244 bp, Trifolium repens
  misc_feature (17)..(17): Any nucleotide
  misc_feature (23)..(23): Any nucleotide
  misc_feature (50)..(50): Any nucleotide
  misc_feature (207)..(208): Any nucleotides
  misc_feature (213)..(213): Any nucleotide
  misc_feature (222)..(222): Any nucleotide
  misc_feature (233)..(233): Any nucleotide
  misc_feature (236)..(236): Any nucleotide
  misc_feature (238)..(238): Any nucleotide
  misc_feature (241)..(241): Any nucleotide
  misc_feature (244)..(244): Any nucleotide
gcattaaacattgacanagtccnaataaaaaagatctgaaacacatagtnccccattttttaacattaaactaaaaatatgtcggccatcaccgcaatccaagtcgagaaccttgaatttccggctgtggttacttctccggccaccggtaagtcatattttcttggtggtgcaggggagagaggtttgactattgaaggaaacttnntcaanggcgctggnatacgaccctnttngnagnagn

SEQ ID NO: 4 - DNA, 606 bp, Trifolium repens
  misc_feature (2)..(2): Any nucleotide
  misc_feature (605)..(606): Any nucleotides
gnttgcccggtcccaacaaagatctgaaacacatagccccccattttttaacattaaactaaaaatatgtctgccatcaccgcaatccaagtcgagaaccttgaattcccggcggtgattacttctccggtcaacggtaagtcatattttcttggtggtgcaggggagagaggtttgactattgaaggaaacttcatcaagttcactgccataggagtatatttggaagatgtagcagtggcttcacttgccactaaatggaagggcaaatcctctgaagagttgcttgagacccttgacttctacagagatatcatttcaggaccatttgagaagttgattcgaggatcgaagattagggaattgagtggtcctgagtactcaaggaaggttaatgaaaactgtgtggcacacttaaaatctgttgggacttacggagatgcagaagttgaagctatgcaaaaatttgttgaagccttcaagcctattaattttccacctggtgcctctgttttttacaggcaatcacctgatggaatattagggcttagtttctctcaagatgcaagtataccagaaaaggaagctgcagtaatagagaacann

SEQ ID NO: 5 - DNA, 599 bp, Trifolium repens
  misc_feature (19)..(19): Any nucleotide
ggatctgaaacacatagtnccccttttaacattaaactaaaaatatgtcggccatcaccgcaatccaagtcgagaaccttgaatttccagctgtgattacttctccggccaccggtaagtcatattttcttggtggtgcaggggagagaggtttgactattgaaggaaacttcatcaagttcactgccataggagtatatttggaagatgtagcagtggcttcacttgccactaaatggaagggtaaatcctctgaggagttgcttgagactcttgacttctatagagacatcatttcaggaccctttgaaaagttgattcgaggatcgaagattagggaattgagtggtcctgagtactcaaggaaggttaatgaaaactgcgtggcccacttaaaatctgttgggacttatggagatgctgaagctgaagctatgcaaaaatttgttgaagccttcaagcctattaattttccacctggtgcctctgttttttacaggcaatcacctgatggaatattagggcttagtttctctcaagatgcaagtataccagaaaaggaggctgcagtaatagagaacaagggagcttcatcggcg

SEQ ID NO: 6 - DNA, 228 bp, Trifolium repens
  misc_feature (2)..(2): Any nucleotide
  misc_feature (15)..(15): Any nucleotide
  misc_feature (31)..(31): Any nucleotide
  misc_feature (54)..(54): Any nucleotide
  misc_feature (212)..(212): Any nucleotide
  misc_feature (214)..(215): Any nucleotides
  misc_feature (217)..(217): Any nucleotide
  misc_feature (221)..(221): Any nucleotide
  misc_feature (223)..(223): Any nucleotide
  misc_feature (225)..(22): Any nucleotide
  misc_feature (225)..(226): Any nucleotides
  misc_feature (228)..(228): Any nucleotide
gngatctgaaaaacntagtacccattttaanattaaactaaaaatatgtcggcnatcaccgcaatccaagtcgagaaccttgaatttccagctgtgattacttctccggccaccggtaagtcatattttcttggtggtgcaggggagagaggtttgactattgaaggaaacttcatcaagttcactgccataggagtatatttggaagatgnannangggntncnntn

SEQ ID NO: 7 - DNA, 589 bp, Trifolium repens
  misc_feature (2)..(2): Any nucleotide
  misc_feature (8)..(8): Any nucleotide
  misc_feature (20)..(20): Any nucleotide
  misc_feature (589)..(589): Any nucleotide
cnttaaanttgaccagtccnaacaaagatctgaaacacatagccccccattttttaacattaaactaaaaatatgtctgccatcaccgcaatccaagtcgagaaccttgacttcccggcggtgattacttctccggtcaacggtaagtcatattttcttggtggtgcaggggagagaggtttgactattgaaggaaacttcatcaagttcactgccataggagtatatttggaagatgtagcagtggcttcacttgccactaaatggaagggcaaatcctctgaagagttgcttcagacccttgacttctacagagatatcatttcaggaccatttgagaagttgattcgaggatccaagattagggaattgagtggtcctgagtactcaaggaaggttaatgaaaactgtgtggcacacttaaaatctgttgggacttatggagatgcagaagttgaagctatgcaaaaatttgttgaagccttcaagcctattaattttccacctggtgcctctgttttttacaggcaatcacctgatggaatattagggcttagtttctctcaagatgcaagtataccagaaaagn

SEQ ID NO: 8 - DNA, 332 bp, Trifolium repens
  misc_feature (29)..(29): Any nucleotide
  misc_feature (36)..(36): Any nucleotide
  misc_feature (206)..(206): Any nucleotide
  misc_feature (313)..(313): Any nucleotide
  misc_feature (326)..(326): Any nucleotide
  misc_feature (331)..(331): Any nucleotide
ttaaaattgacacagtcccaaccttaaanttgaccnggtcccaaacaaagatctgaaacaacatagccccccattttttaacattaaactaaaaatatgtctgccatcaccgcaatccaagtcgagaaccttgaattcccggcggtgattacttctccggtcaacggtaagtcatattttcttggtggtgcaggggagagaggttngactattgaaggaaacttcatcaagttcactgccataggagtatatttggaagatgtagcaggggcttcacttgccactaaatggaagggcagatcctctgaagagngcttgagaccctngactnc

SEQ ID NO: 9 - protein, 78 aa, Trifolium repens
  MISC_FEATURE (37)..(37): Any amino acid
  MISC_FEATURE (73)..(73): Any amino acid
  MISC_FEATURE (77)..(77): Any amino acid
MSAITAIQVENLEFPAVITSPVNGKSYFLGGAGERGXTIEGNFIKFTAIGVYLEDVAGASLATKWKGRSSEEXLRPXT

SEQ ID NO: 10 - DNA, 332 bp, Trifolium repens
  misc_feature (13)..(13): Any nucleotide
  misc_feature (19)..(19): Any nucleotide
  misc_feature (29)..(29): Any nucleotide
  misc_feature (36)..(36): Any nucleotide
  misc_feature (297)..(297): Any nucleotide
  misc_feature (310)..(310): Any nucleotide
  misc_feature (313)..(313): Any nucleotide
  misc_feature (315)..(315): Any nucleotide
  misc_feature (320)..(320): Any nucleotide
  misc_feature (324)..(324): Any nucleotide
  misc_feature (326)..(326): Any nucleotide
  misc_feature (331)..(332): Any nucleotides
ttaaaattgaccnagtccnaaccttaaanttgaccnggtcccaaacaaagatctgaaacaacatagccccccattttttaacattaaactaaaaatatgtctgccatcaccgcaatccaagtcgagaaccttgaattcccggcggtgattacttctccggtcaacggtaagtcatattttcttggtggtgcaggggagagaggtttgactattgaaggaaacttcatcaagttcactgccataggagtatatttggaagatgtagcaggggcttcacttgccactaaatggaagggnagatcctctgaanagngnttganaccntngactnn

SEQ ID NO: 11 - DNA, 331 bp, Trifolium repens
  misc_feature (5)..(5): Any nucleotide
  misc_feature (28)..(28): Any nucleotide
  misc_feature (35)..(35): Any nucleotide
  misc_feature (205)..(205): Any nucleotide
  misc_feature (298)..(298): Any nucleotide
  misc_feature (301)..(301): Any nucleotide
ttaanttgacacagtcccaaccttaaanttgaccnggtcccaaacaaagatctgaaacaacatagccccccattttttaacattaaactaaaaatatgtctgccatcaccgcaatccaagtcgagaaccttgaattcccggcggtgattacttctccggtcaacggtaagtcatattttcttggtggtgcaggggagagaggttngactattgaaggaaacttcatcaagttcactgccataggagtatatttggaagatgtagcaggggcttcacttgccactaaatggaagggcanatnctctgaagagtgcttgagacccttgacttc

SEQ ID NO: 12 - DNA, 186 bp, Trifolium repens
  misc_feature (22)..(22): Any nucleotide
  misc_feature (135)..(135): Any nucleotide
  misc_feature (143)..(143): Any nucleotide
  misc_feature (157)..(157): Any nucleotide
  misc_feature (167)..(167): Any nucleotide
  misc_feature (173)..(174): Any nucleotides
  misc_feature (178)..(179): Any nucleotides
  misc_feature (181)..(182): Any nucleotides
  misc_feature (184)..(184): Any nucleotide
  misc_feature (186)..(186): Any nucleotide
gcgttaaaattgacccagtccnaacaaagatctgaaacacatagccccccattttttaacattaaactaaaaatatgtctgccatcaccgcaatccaagtcgagaaccttgacttcccggcggagattacttctncggggaangggaagggatattntcttggtggnggaggnnaganngnntngn

SEQ ID NO: 13 - DNA, 274 bp, Trifolium repens
  misc_feature (6)..(6): Any nucleotide
  misc_feature (9)..(9): Any nucleotide
  misc_feature (12)..(12): Any nucleotide
  misc_feature (15)..(15): Any nucleotide
  misc_feature (18)..(18): Any nucleotide
gttagnagnagnatntcnggcaccctttgaaaagttgattcgaggatcgaagattagggaattgagtggtcctgagtactcaaggaaggttaatgaaaactgcgtggcacacttaaaatctgttgggacttatggagatgcagaagctgaagctatgcaaaaatttgttgaagccttcaagcctattaattttccacctggtgcctctgttttttacaggcaatcacctgatggaatattaggggttagtattgccaattcattttttttaact

SEQ ID NO: 14 - protein, 94 aa, Trifolium repens
APFEKLIRGSKIRELSGPEYSRKVNENCVAHLKSVGTYGDAEAEAMQKFVEAFKPINFPPGASVFYRQSPDGILGVSIANSFFLTILIRVRFDC

SEQ ID NO: 15 - DNA, 274 bp, Trifolium repens
  misc_feature (6)..(6): Any nucleotide
  misc_feature (9)..(9): Any nucleotide
  misc_feature (12)..(13): Any nucleotides
  misc_feature (18)..(18): Any nucleotide
gttagnagnatnntttcnggcaccctttgaaaagttgattcgaggatcgaagattagggaattgagtggtcctgagtactcaaggaaggttaatgaaaactgcgtggcacacttaaaatctgttgggacttatggagatgcagaagctgaagctatgcaaaaatttgttgaagccttcaagcctattaattttccacctggtgcctctgttttttacaggcaatcacctgatggaatattaggggttagtattgccaattcattttttttaact

SEQ ID NO: 16 - DNA, 264 bp, Trifolium repens
  misc_feature (2)..(2): Any nucleotide
  misc_feature (5)..(5): Any nucleotide
  misc_feature (9)..(9): Any nucleotide
gnatntttnggaccctttgaaaagttgattcgaggatcgaagattagggaattgagtggtcctgagtactcaaggaaggttaatgaaaactgcgtggcacacttaaaatctgttgggacttatggagatgcagaagctgaagctatgcaaaaatttgttgaagccttcaagcctattaattttccacctggtgcctctgttttttacaggcaatcacctgatggaatattaggggttagtattgccaattcattttttttaact

SEQ ID NO: 17 - DNA, 825 bp, Trifolium repens
  misc_feature (3)..(3): Any nucleotide
  misc_feature (5)..(5): Any nucleotide
  misc_feature (7)..(10): Any nucleotides
  misc_feature (13)..(14): Any nucleotides
  misc_feature (487)..(488): Any nucleotides
  misc_feature (507)..(507): Any nucleotide
  misc_feature (545)..(545): Any nucleotide
  misc_feature (579)..(579): Any nucleotide
  misc_feature (654)..(654): Any nucleotide
  misc_feature (716)..(716): Any nucleotide
  misc_feature (719)..(719): Any nucleotide
  misc_feature (725)..(725): Any nucleotide
  misc_feature (738)..(738): Any nucleotide
  misc_feature (762)..(762): Any nucleotide
  misc_feature (787)..(787): Any nucleotide
ttnantnnnnttnncgggcaattacaactacacaacaccttctccattaccatctatcttctactaagttcaacgagatcaatggcacttccttctgtcaccgctttgaatatcgagaacaatctattccctcctaccgtcacaccaccgggatccaccaacaatttcttcctcggcggtgcaggagagcggggtcttcaaattcaagacaaatttgtcaaattcaccgctattggtgtttatctacaggacattgctgttccttacctcgccactaaatggaagggtaagactgctcaagagctaacggaaactgttcctttcttcagggacatcgttacaggtccatttgagaaatttatgcaggtgacaatgatcttgccattgactgggcaacaatactcagagaaagtgtcagaaaattgtgtagctatttggaagtctcttgggatttataccgacgaagaagccaaagcaattgagaagnntgtttctgtcttcaaagangaaacattcccaccaggctcctctatccttttcacagnattacccaaaggattaggatcactaacgataagnttctctaaagatggatccattccagagaccgagtctgcagttatagagaataagctactctcacaagctgtgctngagtcgatgataggggcacacggtgtctcccctgcagcaaaacagagttttggccaccaggntanccgagntattcaacgaggntggctgatgcctagcaacttgatnatatcaacaaaacgaaaatgaaagnccttttctgcaataaagaacaagcggaaattttatttt

SEQ ID NO: 18 - protein, 230 aa, Trifolium repens
  MISC_FEATURE (163)..(163): Any amino acid
  MISC_FEATURE (188)..(188): Any amino acid
  MISC_FEATURE (209)..(210): Any amino acids
  MISC_FEATURE (212)..(212): Any amino acid
  MISC_FEATURE (216)..(216): Any amino acid
  MISC_FEATURE (224)..(224): Any amino acid
MALPSVTALNIENNLFPPTVTPPGSTNNFFLGGAGERGLQIQDKFVKFTAIGVYLQDIAVPYLATKWKGKTAQELTETVPFFRDIVTGPFEKFMQVTMILPLTGQQYSEKVSENCVAIWKSLGIYTDEEAKAIEKVSVFKETFPPGSSILFTLPKGLGSLTIXFSKDGSIPETESAVIENKLLSQAVXESMIGAHGVSPAAKQSFGHQXXRXIQRXWLMPSNLXISTKRK

SEQ ID NO: 19 - DNA, 807 bp, Trifolium repens
  misc_feature (3)..(3): Any nucleotide
  misc_feature (5)..(5): Any nucleotide
  misc_feature (7)..(10): Any nucleotides
  misc_feature (13)..(14): Any nucleotides
  misc_feature (21)..(21): Any nucleotide
  misc_feature (23)..(23): Any nucleotide
  misc_feature (25)..(25): Any nucleotide
  misc_feature (99)..(99): Any nucleotide
  misc_feature (147)..(147): Any nucleotide
  misc_feature (229)..(229): Any nucleotide
  misc_feature (288)..(288): Any nucleotide
  misc_feature (316)..(316): Any nucleotide
  misc_feature (335)..(335): Any nucleotide
  misc_feature (337)..(338): Any nucleotides
  misc_feature (417)..(417): Any nucleotide
  misc_feature (434)..(434): Any nucleotide
  misc_feature (437)..(437): Any nucleotide
  misc_feature (486)..(487): Any nucleotides
  misc_feature (506)..(506): Any nucleotide
  misc_feature (544)..(544): Any nucleotide
  misc_feature (561)..(561): Any nucleotide
  misc_feature (578)..(578): Any nucleotide
  misc_feature (625)..(625): Any nucleotide
  misc_feature (653)..(653): Any nucleotide
  misc_feature (672)..(673): Any nucleotides
  misc_feature (682)..(683): Any nucleotides
  misc_feature (685)..(685): Any nucleotide
  misc_feature (690)..(690): Any nucleotide
  misc_feature (695)..(695): Any nucleotide
  misc_feature (706)..(707): Any nucleotides
  misc_feature (715)..(715): Any nucleotide
  misc_feature (718)..(718): Any nucleotide
  misc_feature (721)..(721): Any nucleotide
  misc_feature (724)..(724): Any nucleotide
  misc_feature (737)..(737): Any nucleotide
  misc_feature (754)..(754): Any nucleotide
  misc_feature (761)..(762): Any nucleotides
  misc_feature (764)..(764): Any nucleotide
  misc_feature (766)..(766): Any nucleotide
  misc_feature (775)..(775): Any nucleotide
  misc_feature (782)..(782): Any nucleotide
  misc_feature (784)..(784): Any nucleotide
  misc_feature (786)..(786): Any nucleotide
ttnantnnnnttnncggtttntnanaactacacaacaccttcttttttccatttatcttctactaagttcaacgagatcaatggcacttccttctgtcnccgctttgaatatcgagaacaatctattccctcctaccgtcacaccancgggatccaccaacaatttcttcctcggcggtgcaggagagcggggtcttcaaattcaagacaaatttgtcaaattcaccgntattggtgtttatctacaggacattgctgttccttacctcgccactaaatggaagggtnagactgctcaagagctaacggaaactgnccctttcttcagggacatngnnacaggtccatttgagaaatttatgcaggtgacaatgatcttgccattgactgggcaacaatactcagagaaagtgtcanaaaattgtgtacctatntgnaagtctcttcggatttataccgaccaagaagccaaagcaattgagaagnntgtttctgtcttcaaagangaaacattcccaccaggctcctctatccttttcacagnattacccaaaggattangatcactaacgataagnttctctaaagatggatccattccagagaccgagtctgcagttatagngaataagctactctcacaagctgtgctngagtcgatgataggggcanncggtgtctnncntgcancaaancatagttttgnncaccaggntanccnagntattcaacgaggntggctgatgcctagcancttgatnntntnaacaaaacnaaaatgnangnccttttctgcattaaagaaca

SEQ ID NO: 20 - DNA, 266 bp, Trifolium repens
  misc_feature (14)..(15): Any nucleotides
  misc_feature (33)..(33): Any nucleotide
  misc_feature (52)..(52): Any nucleotide
  misc_feature (200)..(200): Any nucleotide
  misc_feature (211)..(211): Any nucleotide
  misc_feature (229)..(229): Any nucleotide
  misc_feature (241)..(242): Any nucleotides
  misc_feature (244)..(244): Any nucleotide
  misc_feature (247)..(247): Any nucleotide
  misc_feature (254)..(254): Any nucleotide
  misc_feature (256)..(256): Any nucleotide
  misc_feature (266)..(266): Any nucleotide
gcaattacaacctnncaacaccttctccttacntctatcttctactaagttnaacgagatcaatggcacttccttctgtgaccgctttgaatatcgagaacaatctattccctcctaccgtcacaccaccgggatccaccaacaatttcttcctcggcggtgcaggagagcggggtcttcaaattcaagacaaatttgtnaaattgaccgntattggtgtttatgtacnggacgttggtgnngnttncgtgggngntggctggatn

SEQ ID NO: 21 - DNA, 797 bp, Trifolium repens
ttacactcacaacaccttctccattaccatctatcttctactaagttcaacgagatcaatggcacttccttctgtcaccgctttgaatatcgagaacaatctattccctcctaccgtcacaccaccgggatccaccaacaatttcttcctcggcggtgcaggagagcggggtcttcaaattcaagacaaatttgtcaaattcaccgctattggtgtttatctacaggacattgctgttccttacctcgccactaaatggaagggtaagactgctcaagagctaacggaaactgttcctttcttcagggacatcgttacaggtccatttgagaaatttatgcaggtgacaatgatcttgccattgactgggcaacaatactcagagaaagtgtcagaaaattgtgtagctatttggaagtctcttgggatttataccgacgaagaagccaaagcaattgagaagtttgtttctgtcttcaaagatgaaacattcccaccaggctcctctatccttttcacagtattacccaaaggattaggatcactaacgataagtttctctaaagatggatccattccagagaccgagtctgcagttatagagaataagctactctcacaagctgtgcttgagtcgatgataggggcgcacggtgtctcccctgcagcaaaacagagtttggccaccaggttatccgagttattcaacgaggttggtgatgctagcaactgattatatcaacaaaacgaaaatgaaagtcctttctgcaataaagaccaagcggaaattttatttt

SEQ ID NO: 22 - DNA, 468 bp, Trifolium repens
  misc_feature (30)..(30): Any nucleotide
  misc_feature (47)..(47): Any nucleotide
  misc_feature (436)..(436): Any nucleotide
  misc_feature (442)..(442): Any nucleotide
  misc_feature (450)..(450): Any nucleotide
  misc_feature (453)..(455): Any nucleotides
  misc_feature (458)..(458): Any nucleotide
  misc_feature (464)..(464): Any nucleotide
  misc_feature (467)..(468): Any nucleotides
tcacattattacaattacaacttaacattnactcgtaaaaagagatnaatggcacttccttctgtcaccgctttggatatcgagaacaatctattccctcccaccgtcacaccaccgggatccactgacaacttcttcctcggcggtgcaggagagaggggtcttcaaatccaagacaaattcgtcaaattcaccgctattggtgtttatctgcaggacattgctgttccttacctcgcagctaaatggaagggtaagactgctcaagagctaactcaaactgttcctttcttcagggacatcgttacaggtccatttgagaaatttatgcaggtgacaatgatcttgccattgactgggcaacaatactcagagaaagtgtcagaaaattgtgtagctatttggaagtctcttgggatatatacggacgaacaanccaaancaattganaannntgnttctgnttnn

SEQ ID NO: 23 - DNA, 1130 bp, Trifolium repens
  misc_feature (5)..(5): Any nucleotide
  misc_feature (7)..(8): Any nucleotides
  misc_feature (28)..(28): Any nucleotide
  misc_feature (38)..(38): Any nucleotide
  misc_feature (53)..(53): Any nucleotide
  misc_feature (61)..(61): Any nucleotide
  misc_feature (91)..(91): Any nucleotide
  misc_feature (101)..(101): Any nucleotide
  misc_feature (107)..(107): Any nucleotide
  misc_feature (115)..(115): Any nucleotide
  misc_feature (138)..(138): Any nucleotide
  misc_feature (154)..(154): Any nucleotide
  misc_feature (191)..(191): Any nucleotide
tattntnngaaaccacttgtgttgaagncgtgaacttngctaccctccatatnatactatnacctcttctgagacccttcatcatagaaanacaacacacntcagcnctttgctntttctacaacaacctataactanacatattatttttatntatttagtatataattgaaataaactgctaaagatanttattaagatatggtgagtgtagctgaaattcgcaaggctcagagggctgaaggccctgcaaccattttggccattggcactgcaaatccagcaaaccgtgttgagcagagcacatatcctgatttctacttcaaaatcacaaacagtgagcacaagactgagctcaaagagaaattccagcgcatgtgtgacaaatctatgatcaagagcagatacatgtatctaacagaagagattttgaaagaaaatcctagtctttgtgaatacatggcaccttcattggatgctaggcaagacatggtggtggttgaggtacctagacttgggaaggaggctgcagtgaaggctattaaagaatggggtcaaccaaagtcaaagattactcacttaatcttttgcaccacaagtggtgtagacatgcctggtgctgattaccaactcacaaaactcttaggtcttcgcccatatgtgaagaggtacatgatgtaccaacaagggtgctttgcaggtgggacggtgcttcgtttggcaaaagatttggccgagaacaacaaaggtgctcgtgtgttggttgtttgttctgaagtaaccgcagtcacattccgcggccccagtgacactcacttggacagtcttgttggacaagcactatttggagatggagctgctgcactcattgttggctcagacccagtaccagaaattgagaaaccaatatttgagatggtatggaccgcacagacaattgctccagacagtgaaggtgccattgatggtcaccttcgtgaagctggactaacatttcatcttcttaaagatgttcctgggattgtatcaaagaacattaataaagcattggtcgaggctttccaaccattaggaatttctgattacaactcaatcttttggattgcacacccgggtggacctgcaattct

SEQ ID NO: 24 - protein, 309 aa, Trifolium repens
MVSVAEIRKAQRAEGPATILAIGTANPANRVEQSTYPDFYFKITNSEHKTELKEKFQRMCDKSMIKSRYMYLTEEILKENPSLCEYMAPSLDARQDMVVVEVPRLGKEAAVKAIKEWGQPKSKITHLIFCTTSGVDMPGADYQLTKLLGLRPYVKRYMMYQQGCFAGGTVLRLAKDLAENNKGARVLVVCSEVTAVTFRGPSDTHLDSLVGQALFGDGAAALIVGSDPVPEIEKPIFEMVWTAQTIAPDSEGAIDGHLREAGLTFHLLKDVPGIVSKNINKALVEAFQPLGISDYNSIFWIAHPGGPAI

SEQ ID NO: 25 - DNA, 663 bp, Trifolium repens
  misc_feature (5)..(5): Any nucleotide
  misc_feature (7)..(8): Any nucleotides
  misc_feature (28)..(28): Any nucleotide
  misc_feature (38)..(38): Any nucleotide
  misc_feature (53)..(53): Any nucleotide
  misc_feature (61)..(61): Any nucleotide
  misc_feature (97)..(97): Any nucleotide
  misc_feature (128)..(128): Any nucleotide
  misc_feature (138)..(139): Any nucleotides
  misc_feature (148)..(148): Any nucleotide
  misc_feature (151)..(151): Any nucleotide
  misc_feature (163)..(163): Any nucleotide
  misc_feature (171)..(171): Any nucleotide
tattntnngaaaccacttgtgttgaagncgtgaacttngctaccctccatatnatactatnacctcttctgagacccttcatcatatatatataacncatctcacctcatacatatttccacaacaanctataacttnncctgttatntanaccaattgagtntcaaattnacatacatagcggaacatactaaatacaacatggttagtgtttctgaaattcgcaaggctcaaagggctgaaggccctgcaactattttggccattggtactgcaaatccagcaaatcgtgttgaccagagtacatatcctgatttctacttcaaaatcactaacagtgagcataaggttgagcttaaagagaaatttcagcgcatgtgtgataaatctatgatcaagagcagatacatgtatctaacagaagagattttgaaagaaaatcctagtctttgtgaatacatggcaccttcattggatgctaggcaagacatggtggtggttgaggtacctagacttgggaaggaggctgcagtgaaagctatcaaagaatggggtcaaccaaagtcaaagattactcacttaatcttttgcaccacaagtggtgttgacatgcctggtgctgattaccaactcacaaaactcttaggtcttcgcccatatgtg

SEQ ID NO: 26 - DNA, 575 bp, Trifolium repens
  misc_feature (2)..(2): Any nucleotide
  misc_feature (4)..(5): Any nucleotides
  misc_feature (18)..(18): Any nucleotide
  misc_feature (47)..(47): Any nucleotide
  misc_feature (65)..(65): Any nucleotide
gnannacaacacacttcnacctttgcttttctacaacaacttctatntaaacctttttttagttnaaacttacactactgctaaagatatatatcaacatggttagtgtgtctgaaattcgcaaggctcaaagggctgaaggccctgcaactattttggccattggcactgcaaatccagcaaaccgtgttgatcagagtacatatcctgatttctacttcaaaatcactaacagtgagcataaagttgagctcaaagagaaattccagcgcatgtgtgataaatctatgatcaagagcagatacatgtatctaacagaagagattttgaaagaaaatcctagtctttgtgaatacatggcaccttcattggatgctaggcaagatatggtggtggttgaggtacctagacttggaaaggaggctgcagtgaaggctattaaagaatggggtcaaccaaaatctaagattacacatttgatcttttgcaccacaagtggtgtagacatgcctggtgctgattaccagcccacaaaacttttaggacttcgtccatatgtgaagaggtacatgatg

SEQ ID NO: 27 - DNA, 607 bp, Trifolium repens
  misc_feature (4)..(4): Any nucleotide
  misc_feature (10)..(10): Any nucleotide
  misc_feature (18)..(18): Any nucleotide
  misc_feature (26)..(26): Any nucleotide
  misc_feature (29)..(30): Any nucleotides
  misc_feature (55)..(55): Any nucleotide
  misc_feature (57)..(57): Any nucleotide
  misc_feature (75)..(76): Any nucleotides
  misc_feature (80)..(81): Any nucleotides
  misc_feature (92)..(95): Any nucleotides
  misc_feature (103)..(104): Any nucleotides
cacnttagcnctttgctntttctacnacnncttctgtctaaaccttttttgagtntnacttgcatacatagaaannctannctgctaaagannnntatcaagnnatggttagtgtgtctgaaattcgcaaggctcaaagggcagaaggccctgcaacaatcttggccattggcactgcaaatccagcaaaccgtgttgatcagagcacatatcctgatttctacttcaaaatcactaacagtgaacataaagttgagctcaaagagaaattccagcgcatgtgtgataaatctatgatcaagagcagatacatgtatctaacagaagagattttgaaagaaaatcctagtctttgtgagcacatggcaccttcattggatgctaggcaagacatggtggtggttgaggtacctagacttgggaaggaggctgcagtgaaagctataaaagaatggggtcaaccaaagtcaaagattactcacttaatcttttgcaccacaagtggtgttgacatgcctggtgctgattaccaactcacaaaactcttaggtcttcgcccatatgtgaagaggtacatgatgtaccaacaagggtgctttgcaggtgg

SEQ ID NO: 28 - DNA, 606 bp, Trifolium repens
  misc_feature (4)..(4): Any nucleotide
  misc_feature (40)..(40): Any nucleotide
  misc_feature (52)..(52): Any nucleotide
cacnttagcctttgcttttctacactcttctgtctaaacnttttttgagttnacttgcatacatagaaactactgctaaagatatcaagatggttagtgtgtctgaaattcgcaaggctcaaagggcagaaggccctgcaacaatcttggccattggcactgcaaatccagcaaaccgtgttgatcagagcacatatcctgatttctacttcaaaatcactaacagtgaacataaagttgagctcaaagagaaattccagcgcatgtgtgataaatctatgatcaagagcagatacatgtatctaacagaagagattttgaaagaaaatcctagtctttgtgagcacatggcaccttcattggatgctaggcaagacatggtggtggttgaggtacctagacttgggaaggaggctgcagtgaaagctataaaagaatggggtcaaccaaagtcaaagattactcacttaatcttttgcaccacaagtggtgttgacatgcctggtgctgattaccaactcacaaaactcttaggtcttcgcccatatgtgaagaggtacatgatgtaccaacaagggtgctttgcaggtgggacggttcttcgtt

SEQ ID NO: 29 - DNA, 594 bp, Trifolium repens
  misc_feature (4)..(4): Any nucleotide
  misc_feature (26)..(26): Any nucleotide
  misc_feature (32)..(33): Any nucleotides
  misc_feature (43)..(43): Any nucleotide
  misc_feature (53)..(53): Any nucleotide
  misc_feature (62)..(62): Any nucleotide
gcanacactctatccctttcttttcntataanntacagtactngcaataaacnactgaattnaattacataaaaatcttactattaagatatggtgagtgtatctgaaattcgtaaggctcaaagggcagaaggccctgcaaccattttagccattggtactgcaaatccagcaaaccgtgtagaccagagcacatatcctgatttctacttcaaaatcactaacagtgagcataaggttgagcttaaagagaaattccagcgcatgtgtgataaatctatgatcaagagcagatacatgtatctaacagaagagattttgaaagaaaatcctagtctttgtgaatacatggcaccttcattggatgctaggcaagacatggtggtggttgaggtacctagactaggaaaggaggctgcagtcaaggccattaaagaatggggtcaaccaaagtcaaagattactcacttaatcttttgcaccacaagtggtgtagacatgcctggtgctgattaccaactcacaaaactcttgggacttcgtccatatgtgaagaggttcatgatgtaccaacaaggttgttttgcaggaggc

SEQ ID NO: 30 - DNA, 708 bp, Trifolium repens
  misc_feature (3)..(3): Any nucleotide
  misc_feature (52)..(52): Any nucleotide
  misc_feature (706)..(706): Any nucleotide
acnaaaacaactacgcatattatatatatatatatagtctataattgaaagnaaactgctaaagatattattaagatatggtgagtgtagctgaaattcgcaaggctcagagggctgaaggccctgcaaccattttggccattggcactgcaaatccaccaaaccgtgttgagcagagcacatatcctgatttctacttcaaaattacaaacagtgagcacaagactgagctcaaagagaagttccaacgcatgtgtgacaaatccatgatcaagagcagatacatgtatctaacagaagagattttgaaagaaaatcctagtctttgtgaatacatggcaccttcattggatgctaggcaagacatggtggtggttgaggtacctagacttgggaaggaggctgcagtcaaggccattaaagaatggggtcaaccaaagtcaaagattactcacttaatcttttgcaccacaagtggtgttgacatgcctggtgctgattaccaactcacaaaactcttaggtcttcgcccatatgtgaaaaggtatatgatgtaccaacaaggttgttttgcaggaggcacggtgcttcgtttggcaaaagatttggccgagaacaacaaaggtgctcgtgtgctagttgtttgttctgaagtcaccgcagtcacatttcgcggccccagtgatactcacttggacagtcttgntg

SEQ ID NO: 31 - DNA, 407 bp, Trifolium repens
  misc_feature (4)..(4): Any nucleotide
  misc_feature (20)..(20): Any nucleotide
  misc_feature (26)..(26): Any nucleotide
  misc_feature (28)..(28): Any nucleotide
  misc_feature (41)..(42): Any nucleotides
  misc_feature (73)..(73): Any nucleotide
  misc_feature (329)..(329): Any nucleotide
  misc_feature (345)..(345): Any nucleotide
  misc_feature (365)..(365): Any nucleotide
  misc_feature (378)..(378): Any nucleotide
  misc_feature (383)..(384): Any nucleotides
  misc_feature (386)..(389): Any nucleotides
  misc_feature (402)..(402): Any nucleotide
  misc_feature (407)..(407): Any nucleotide
ccanggaaaacaacctccgngcatantntatatatatatanngtctataattgaaagaaactactaaagatanttattaagatatggtgagtgtagctgaaattcgcaaggctcagagggctgaaggccctgcaaccattttggccattggcactgcaaatccaccaaaccgtgttgagcagagcacatatcctgatttctacttcaaaattacaaacagtgagcacaagactgagctcaaagagaagttccaacgcatgtgtgacaaatccatgatcaagagcagatacatgtatctaacagaagagattttgaaagaaaatcctagnctttgtgaatacatgncaccttcattggatgctagncaagacatggtgncgccnnannnncccaccctccccncgccn

SEQ ID NO: 32 - DNA, 483 bp, Trifolium repens
  misc_feature (2)..(2): Any nucleotide
  misc_feature (21)..(21): Any nucleotide
  misc_feature (37)..(37): Any nucleotide
  misc_feature (388)..(388): Any nucleotide
  misc_feature (408)..(409): Any nucleotides
  misc_feature (444)..(444): Any nucleotide
  misc_feature (449)..(449): Any nucleotide
  misc_feature (453)..(453): Any nucleotide
  misc_feature (476)..(476): Any nucleotide
  misc_feature (479)..(479): Any nucleotide
  misc_feature (483)..(483): Any nucleotide
gnacaaaaacactcgcatatncatatatctctctctngtctataattgaaagaaactgctaaagatattattaagatatggtgagtgtagctgaaattcgcaaggctcagagggctgaaggccctgcaaccattttggccattggcactgcaaatccaccaaaccgtgttgagcagagcacatatcctgatttctacttcaaaattacaaacagtgagcacaagactgagctcaaagagaagttccaacgcatgtgtgacaaatccatgatcaagagcagatacatgtatctaacagaagagattttgaaagaaaatcctagtctttgtgaatacatggcaccttcattggatgctaggcaagacatggtggtggttgaggtacctanacttgggaaggaggctgcanncaaggccattaaagaatggggtcaaccaaagtcanagatnactnacttaatcttttgcaccacaagnggngccn

SEQ ID NO: 33 - DNA, 586 bp, Trifolium repens
  misc_feature (14)..(14): Any nucleotide
  misc_feature (20)..(20): Any nucleotide
  misc_feature (26)..(26): Any nucleotide
  misc_feature (36)..(36): Any nucleotide
  misc_feature (42)..(42): Any nucleotide
  misc_feature (73)..(73): Any nucleotide
gcacaaaaacactncgctanttatantatatatatntatatnatatataattgaaagaaactactaaagatanttattaagatatggtgagtgtagcagaaattcgcaaggctcagagggctgaaggccctgcaaccattttggccattggcactgcaaatccaccaaaccgtgttgagcagagcacatatcctgatttctacttcaaaattacaaacagtgagcacaagactgagctcaaagagaagttccaacgcatgtgtgacaaatccatgatcaagagcagatacatgtatctaacagaagagattttgaaagaaaatcctagtctttgtgaatacatggcaccttcattggatgctagacaagacatggtggtggttgaggtacctagacttgggaaggaggctgcagtcaaggctatcaaagaatggggtcaaccaaaatctaagattacacatttgatcttttgcaccacaagtggtgtagacatgcctggtgctgattaccaactcacaaaactcttaggacttcgtccatatgtgaagaggtacatgatgtaccaacaagggtgctttgcaggtgg

SEQ ID NO: 34 - DNA, 574 bp, Trifolium repens
  misc_feature (3)..(3): Any nucleotide
  misc_feature (8)..(8): Any nucleotide
  misc_feature (11)..(11): Any nucleotide
  misc_feature (18)..(19): Any nucleotides
  misc_feature (28)..(28): Any nucleotide
  misc_feature (30)..(31): Any nucleotides
  misc_feature (34)..(35): Any nucleotides
  misc_feature (43)..(43): Any nucleotide
  misc_feature (45)..(46): Any nucleotides
  misc_feature (51)..(51): Any nucleotide
gcnacaanctntaacttnncctgttatntnnacnnattgagtntnnaattnacatacatagcggaacatactaaatacaacatggttagtgtttctgaaattcgcaaggctcaaagggctgaaggccctgcaactattttggccattggcactgcaaatccagcaaaccgtgttgatcagagcacatatcctgatttttacttcaaaatcactaacagtgagcataaggttgagcttaaagagaaatttcagcgcatgtgtgataaatctatgatcaagagcagatacatgtatctaacagaagagattttgaaagaaaatcctagtctttgtgaatacatggcaccttcattggatgctaggcaagacatggtggtggttgaggtacctagacttgggaaggaggctgcagtgaaagctatcaaagaatggggtcaaccaaagtcaaagattactcacttaatcttttgcaccacaagtggtgtagacatgcctggagctgattaccaactcacaaaactcttaggtcttcgcccatatgtgaagaggtacatgatgtaccaacaagggtgct

SEQ ID NO: 35 - DNA, 604 bp, Trifolium repens
  misc_feature (32)..(32): Any nucleotide
aaaacaaccccgcatattatatatatatatangtctataattgaaagaaactgctaaagatattattaagatatggtgagtgtagctgaaattcgcaaggctcagagggctgaaggccctgcaaccattttggccattggtactgcaaatccaccaaaccgtgttgagcggagcacatatcctgatttctacttcaaaattacaaacagtgagcacaagactgagctcaaagagaagttccaacgcatgtgtgacaaatccatgatcaagagcagatacatgtatctaacagaagagattttgaaagaaaatcctagtctttgtgaatacatggcaccttcattggatgctaggcaagacatggtggtggttgaggtacctagacttgggaaggaggctgcagtgaaagctatcaaagaatggggtcaaccaaagtcaaagattactcacttaatcttttgcaccacaagtggtgtagacatgcctggagctgattaccaactcacaaaactcttaggtcttcgcccatatgtgaaaaggtatatgatgtaccaacaaggttgttttgcaggaggcacggtgcttcgtttggcaaaagatttgg

SEQ ID NO: 36 - DNA, 570 bp, Trifolium repens
  misc_feature (9)..(9): Any nucleotide
  misc_feature (37)..(37): Any nucleotide
caacaaccntaacttcctgttattaaccattgagttnaattacatacatagcggaacatactaaatacaacatggttagtgtttctgaaattcgcaaggctcaaagggctgaaggccctgcaactattttggccattggtactgcaaatccagcaaatcgtgttgaccagagtacatatcctgatttctacttcaaaatcactaacagtgagcataaggttgagcttaaagagaaatttcagcgcatgtgtgataaatctatgatcaagagcagatacatgtatctaacagaagagattttgaaagaaaatcctagtctttgtgaatacatggcaccttcattggatgctaggcaagacatggtggtggttgaggtacctagacttgggaaggaggctgcagtgaaagctatcaaagaatggggtcaaccaaagtcaaagattactcacttaatcttttgcaccacaagtggtgttgacatgcctggtgccgattaccaactcacaaaactcttaggtcttcgcccatatgtgaagaggtacatgatgtaccaacaagggtgctttgcag

SEQ ID NO: 37 - DNA, 598 bp, Trifolium repens
  misc_feature (10)..(10): Any nucleotide
  misc_feature (17)..(18): Any nucleotides
  misc_feature (26)..(27): Any nucleotides
  misc_feature (29)..(30): Any nucleotides
  misc_feature (34)..(34): Any nucleotide
  misc_feature (42)..(42): Any nucleotide
  misc_feature (44)..(45): Any nucleotides
  misc_feature (50)..(50): Any nucleotide
  misc_feature (67)..(67): Any nucleotide
caacaacctntaacttnncctgttanntnnaccnattgagtntnnaattnacatacatagcggaacntactaaatacaacatggttagtgtttctgaaattcgcaaggctcaaagggctgaaggccctgcaactattttggccattggtactgcaaatccagcaaatcgtgttgaccagagtacatatcctgatttctacttcaaaatcactaacagtgagcataaggttgagcttaaagagaaatttcagcgcatgtgtgataaatctatgatcaagagcagatacatgtatctaacagaagagattttgaaagaaaatcctagtctttgtgaatacatggcaccttcattggatgctaggcaagacatggtggtggttgaggtacctagacttgggaaggaggctgcagtgaaagctatcaaagaatggggtcaaccaaagtcaaagattactcacttaatcttttgcaccacaagtggtgtagacatgcctggagctgattaccaactcacaaaactcttaggtcttcgcccatatgtgaagaggtacatgatgtaccaacaagggtgctttgcaggtgggacggttcttcgttt

SEQ ID NO: 38 - DNA, 609 bp, Trifolium repens
  misc_feature (3)..(3): Any nucleotide
  misc_feature (32)..(32): Any nucleotide
  misc_feature (34)..(34): Any nucleotide
ganaaaaacactccgcatattatatatatatntntatagtctataattgaaagaaactgctaaagatattattaagatatggtgagtgtagctgaaattcgcaaggctcagagggctgaaggccctgcaaccattttggccattggcactgcaaatccaccaaaccgtgttgagcagagcacatatcctgatttctacttcaaaattacaaacagtgagcacaagactgagctcaaagagaagttccaacgcatgtgtgacaaatccatgatcaagagcagatacatgtatctaacagaagagattttgaaagaaaatcctagtctttgtgaatacatggcaccttcattggatgctaggcaagacatggtggtggttgaggtacctagacttgggaaggaggctgcagtcaaggccattaaagaatggggtcaaccaaagtcaaagattactcacttaatcttttgcaccacaagtggtgttgacatgcctggtgctgattaccaactcacaaaactcttaggtcttcgcccatatgtgaaaaggtatatgatgtaccaacaaggttgttttgcaggaggcacggtgcttcgtttggcaaaagatttg

SEQ ID NO: 39 - DNA, 390 bp, Trifolium repens
  misc_feature (8)..(8): Any nucleotide
  misc_feature (37)..(37): Any nucleotide
  misc_feature (97)..(97): Any nucleotide
  misc_feature (334)..(334): Any nucleotide
  misc_feature (345)..(345): Any nucleotide
  misc_feature (349)..(349): Any nucleotide
  misc_feature (353)..(353): Any nucleotide
  misc_feature (363)..(363): Any nucleotide
  misc_feature (366)..(366): Any nucleotide
  misc_feature (369)..(369): Any nucleotide
  misc_feature (371)..(371): Any nucleotide
  misc_feature (376)..(376): Any nucleotide
  misc_feature (380)..(380): Any nucleotide
  misc_feature (390)..(390): Any nucleotide
aacaaccnataacttcctgttattaaccattgagttnaattacatacatagcggaacatactaaatacaacatggttagtgtttctgaaattcgcanggctcaaagggctgaaggccctgcaactattttggccattggtactgcaaatccagcaaatcgtgttgaccagagtacatatcctgatttctacttcaaaatcactaacagtgagcataaggttgagcttaaagagaaatttcagcgcatgtgtgataaatctatgatcaagagcagatacatgtatctaacagaagagattttgaaagaaaatcctagtctttgtgaatacatggnaccttcattgnatgntagncaagacatgntgntgncngaggnaccnagacttgccn

SEQ ID NO: 40 - DNA, 561 bp, Trifolium repens
  misc_feature (15)..(16): Any nucleotide
  misc_feature (37)..(38): Any nucleotides
  misc_feature (69)..(69): Any nucleotide
  misc_feature (485)..(485): Any nucleotide
  misc_feature (507)..(507): Any nucleotide
  misc_feature (511)..(511): Any nucleotide
  misc_feature (520)..(520): Any nucleotide
  misc_feature (530)..(530): Any nucleotide
  misc_feature (543)..(543): Any nucleotide
  misc_feature (554)..(554): Any nucleotide
  misc_feature (557)..(558): Any nucleotides
  misc_feature (561)..(561): Any nucleotide
aaaaaacaacctacnngcatattatatatatatatanngtctataattgaaagaaactactaaagatanttattaagatatggtgagtgtagctgaaattcgcaaggctcagagggctgaaggccctgcaaccattttggccattggcactgcaaatccaccaaaccgtgttgagcagagcacatatcctgatttctacttcaaaattacaaacagtgagcacaagactgagctcaaagagaagttccaacgcatgtgtgacaaatccatgatcaagagcagatacatgtatctaacagaagagattttgaaagaaaatcctagtctttgtgaatacatggcaccttcattggatgctagacaagacatggtggtggttgaggtacctagacttgggaaggaggctgcagtcaaggctatcaaagaatggggtcaaccaaaatctaagattacacatttgatcttttgcaccacaagtggtgtanacatgcctggtgctgattaccnactngcaaaactnttaggacttngcccatatgtgangaggcgcgtgntgnnccn

SEQ ID NO: 41 - DNA, 543 bp, Trifolium repens
  misc_feature (1)..(2): Any nucleotides
  misc_feature (14)..(15): Any nucleotides
  misc_feature (20)..(20): Any nucleotide
  misc_feature (25)..(25): Any nucleotide
  misc_feature (28)..(28): Any nucleotide
  misc_feature (31)..(31): Any nucleotide
  misc_feature (40)..(40): Any nucleotide
  misc_feature (42)..(42): Any nucleotide
  misc_feature (48)..(48): Any nucleotide
nnaacctataactnnccctnttatntanacncattgagtntnaaattnacatacatagcggaacatactaaatacaacatggttagtgtttctgaaattcgcaaggctcaaagggctgaaggccctgcaactattttggccattggtactgcaaatccagcaaatcgtgttgaccagagtacatatcctgatttctacttcaaaatcactaacagtgagcataaggttgagcttaaagagaaatttcagcgcatgtgtgataaatctatgatcaagagcagatacatgtatctaacagaagagattttgaaagaaaatcctagtctttgtgaatacatggcaccttcattggatgctaggcaagacatggtggtggttgaggtacctagacttgggaaggaggctgcagtgaaagctatcaaagaatggggtcaaccaaagtcaaagattactcacttaatcttttgcaccacaagtggtgttgacatgcctggtgctgattaccaactcacaaaactcttaggtcttcgcccatatgtgaag

SEQ ID NO: 42 - DNA, 437 bp, Trifolium repens
  misc_feature (3)..(3): Any nucleotide
  misc_feature (13)..(13): Any nucleotide
  misc_feature (16)..(16): Any nucleotide
  misc_feature (21)..(21): Any nucleotide
  misc_feature (30)..(31): Any nucleotides
  misc_feature (35)..(36): Any nucleotides
  misc_feature (38)..(38): Any nucleotide
  misc_feature (41)..(42): Any nucleotides
  misc_feature (54)..(54): Any nucleotide
  misc_feature (59)..(59): Any nucleotide
  misc_feature (373)..(373): Any nucleotide
  misc_feature (388)..(388): Any nucleotide
  misc_feature (394)..(394): Any nucleotide
  misc_feature (407)..(408): Any nucleotides
  misc_feature (434)..(434): Any nucleotide
  misc_feature (437)..(437): Any nucleotide
ggntaaccaaccntanacttncctgttatnncttnnanatnntacatacatagncagcnaaacaaagatatcaacatatggttagtgtttctgaaattcgtaaggctcaaagggcagaaggccctgcaactattttggccattggtactgcaaatccagcaaaccgtgttgatcagagtacatatcctgatttctacttcaaaatcactaacagtgagcataaagttgagctcaaagagaaattccagcgcatgtgtgataaatctatgatcaagagcagatacatgtatctaacagaagagattttgaaagaaaatcctagtctttgtgaatacatggcaccttcattggatgctaggcaagatatggtggncgttgaggtacctanacttgnaaaggaggctgcnntgaaggctattaaagaatggggccanccn

SEQ ID NO: 43 - DNA, 607 bp, Trifolium repens
  misc_feature (13)..(13): Any nucleotide
  misc_feature (18)..(18): Any nucleotide
  misc_feature (23)..(23): Any nucleotide
  misc_feature (29)..(29): Any nucleotide
  misc_feature (32)..(32): Any nucleotide
  misc_feature (35)..(35): Any nucleotide
  misc_feature (66)..(66): Any nucleotide
caacaaaaacacntcgcnatatntatatnatnttngtctataattgaaagaaactgctaaagatanttattaagatatggtgagtgtagctgaaattcgcaaggctcagagggctgaaggccctgcaaccattttggccattggcactgcaaatccaccaaaccgtgttgagcagagcacatatcctgatttctacttcaaaattacaaacagtgagcacaagactgagctcaaagagaagttccaacgcatgtgtgacaaatccatgatcaagagcagatacatgtatctaacagaagagattttgaaagaaaatcctagtctttgtgaatacatggcaccttcattggatgctaggcaagacatggtggtggttgaggtacctagacttgggaaggaggctgcagtgaaagctatcaaagaatggggtcaaccaaagtcaaagattactcacttaatcttttgcaccacaagtggtgtagacatgcctggagctgattaccaactcacaaaactcttaggtcttcgcccatatgtgaaaaggtatatgatgtaccaacaaggttgttttgcaggaggcacggtgcttcgtttggcaaaagatttg

SEQ ID NO: 44 - DNA, 581 bp, Trifolium repens
  misc_feature (7)..(7): Any nucleotide
  misc_feature (11)..(11): Any nucleotide
  misc_feature (17)..(17): Any nucleotide
  misc_feature (29)..(29): Any nucleotide
  misc_feature (33)..(33): Any nucleotide
  misc_feature (64)..(64): Any nucleotide
aacactncgcnatattntatatatatatntatngtctataattgaaagaaactgctaaagatanttattaagatatggtgagtgtagctgaaattcgcaaggctcagagggctgaaggccctgcaaccattttggccattggcactgcaaatccaccaaaccgtgttgagcagagcacatatcctgatttctacttcaaaattacaaacagtgagcacaagactgagctcaaagagaagttccaacgcatgtgtgacaaatccatgatcaagagcagatacatgtatctaacagaagagattttgaaagaaaatcctagtctttgtgaatacatggcaccttcattggatgctaggcaagacatggtggtggttgaggtacctagacttgggaaggaggctgcagtcaaggccattaaagaatggggtcaaccaaagtcaaagattactcacttaatcttttgcaccacaagtggtgttgacatgcctggtgctgattaccaactcacaaaactcttaggtcttcgcccatatgtgaaaaggtatatgatgtaccaacaaggttgttttgcaggaggcacg

SEQ ID NO: 45 - DNA, 588 bp, Trifolium repens
  misc_feature (9)..(10): Any nucleotides
  misc_feature (16)..(16): Any nucleotide
  misc_feature (20)..(20): Any nucleotide
  misc_feature (25)..(28): Any nucleotides
  misc_feature (32)..(33): Any nucleotides
  misc_feature (63)..(63): Any nucleotide
aaacaaccnnccgcantatntatannnntatnngtcataattgaaagaaactgctaaagatanttattaagatatggtgagtgtagctgaaattcgcaaggctcagagggctgaaggccctgcaaccattttggccattggcactgcaaatccaccaaaccgcgttgagcagagcacatatcctgatttctacttcaaaattacaaacagtgagcacaagactgagctcaaagagaagttccaacgcatgtgtgacaaatccatgatcaagagcagatacatgtatctaacagaagagattttgaaagaaaatcctagtctttgtgaatacatggcaccttcattggatgctaggcaagacatggtggtggttgaggtacctagacttgggaaggaggctgcagtcaaggctatcaaagaatggggtcaaccaaaatctaagattacacatttgatcttttgcaccacaagtggtgtagacatgcctggtgctgattaccaactcacaaaactcttgggacttcgtccatatgtgaagagattcatgatgtaccaacaaggctgctttgcaggtgggacggttcttcg

SEQ ID NO: 46 - DNA, 613 bp, Trifolium repens
  misc_feature (5)..(5): Any nucleotide
  misc_feature (7)..(7): Any nucleotide
  misc_feature (12)..(13): Any nucleotides
  misc_feature (17)..(18): Any nucleotides
  misc_feature (20)..(22): Any nucleotides
  misc_feature (24)..(24): Any nucleotide
  misc_feature (26)..(27): Any nucleotides
  misc_feature (29)..(29): Any nucleotide
  misc_feature (50)..(50): Any nucleotide
  misc_feature (60)..(60): Any nucleotide
caacncntcgcnntatnntnnntntnntngtctataattgaaagaaactnctaaagatanttattaagatatggtgagtgtagctgaaattcgcaaggctcagagggctgaaggccctgcaaccattttggccattggcactgcaaatccaccaaaccgtgttgagcagagcacatatcctgatttctacttcaaaattacaaacagtgagcacaagactgagctcaaagagaagttccaacgcatgtgtgacaaatccatgatcaagagcagatacatgtatctaacagaagagattttgaaagaaaatcctagtctttgtgaatacatggcaccttcattggatgctaggcaagacatggtggtggttgaggtacctagacttgggaaggaagctgcagtcaaggccattaaagaatggggtcagccaaagtcaaagattactcacttaatcttttgcaccacaagtggtgttgacatgcctggagctgattaccaactcacaaaactcttaggtcttcgcccatatgtgaaaaggtatatgatgtaccaacaaggttgttttgcaggaggcacggtgcttcgtttggcaaaagatttggccgagaacaac

SEQ ID NO: 47 - DNA, 544 bp, Trifolium repens
  misc_feature (3)..(3): Any nucleotide
  misc_feature (6)..(6): Any nucleotide
  misc_feature (20)..(21): Any nucleotides
ccnatnaccttcctgttatnncttacatatactacatacatagcaggagcaaagatatcaacatatggttactgtttctgaaattcgcaaggctcaaagggctgaaggccctgcaaccattttggccattggtactgcaaatccagcaaaccgtgttgatcagagtacatatcctgatttctacttcaaaatcactaacagtgagcataaggttgagctcaaggagaaattccagcgcatgtgtgacaaatctatgatcaagagcagatacatgtatctaacagaagagattttgaaagaaaatcctagtctttgtgaatacatggcaccttcattggatgctaggcaagatatggtggtcgttgaggtacctagactgggaaaggaagctgcagtgaaggctattaaagaatggggtcaaccaaagtcaaagattactcacttaatcttttgcactacaagtggtgtagacatgcctggtgctgattaccagctcacaaaactcttaggtcttcgcccatatgtgaagaggtatatgatgtat

SEQ ID NO: 48 - DNA, 555 bp, Trifolium repens
  misc_feature (4)..(5): Any nucleotides
  misc_feature (8)..(8): Any nucleotide
  misc_feature (11)..(11): Any nucleotide
  misc_feature (21)..(22): Any nucleotides
  misc_feature (513)..(513): Any nucleotide
accnnatnacntactgttatnncttacatatactacatagcaggactgcaaaattcaagtatcaacatatggttactgtttctgaaattcgcaaggctcaaagggctgaaggccctgcaaccattttggccattggtactgcaaatccagcaaaccgtgttgatcagagtacatatcctgatttctacttcaaaatcactaacagtgagcataaggttgagctcaaggagaaattccagcgcatgtgtgataaatctatgatcaagagcagatacatgtatctaacagaagagattttgaaagaaaatcctagtctgtgtgagtacatggcaccttcattggatgctaggcaagacatggttgtggttgaggtacctagacttggaaaggaggctgcagtcaaggccattaaagaatggggtcaaccaaagtcaaagattactcacttaatcttttgcaccacaagtggtgtagacatgcctggtgctgattaccaactcacaaaactcttangtcttcgtccatacgtgaagagggacatgatgtaccaacaag

SEQ ID NO: 49 - DNA, 570 bp, Trifolium repens
  misc_feature (3)..(3): Any nucleotide
  misc_feature (5)..(5): Any nucleotide
  misc_feature (13)..(13): Any nucleotide
  misc_feature (25)..(25): Any nucleotide
  misc_feature (58)..(58): Any nucleotide
acncntcgctatntatttatatatntagtctataattgaaagaaactgctaaagatanttattaagatatggtgagtgtagctgaaattcgcaaggctcagagggctgaaggccctgcaaccattttggccattggcactgcaaatccaccaaaccgtgttgagcagagcacatatcctgatttctacttcaaaattacaaacagtgagcacaagactgagctcaaagagaagttccaacgcatgtgtgacaaatccatgatcaagagcagatacatgtatctaacagaagagattttgaaagaaaatcctagtctttgtgaatacatggcaccttcattggatgctaggcaagacatggtggtggttgaggtacctagacttgggaaggaggctgcagtcaaggccattaaagaatggggtcaaccaaagtcaaagattactcacttaatcttttgcaccacaagtggtgttgacatgcctggtgctgattaccaactcacaaaactcttaggtcttcgcccatatgtgaaaaggtatatgatgtaccaacaaggttgttttgcaggag

SEQ ID NO: 50 - DNA, 546 bp, Trifolium repens
  misc_feature (6)..(6): Any nucleotide
  misc_feature (25)..(25): Any nucleotide
  misc_feature (35)..(35): Any nucleotide
  misc_feature (49)..(49): Any nucleotide
actatnactactgtttacttacatntactcatagnggactgcaagtatnagtataacatatggttactgtttctgaaattcgcaaggctcaaagggctgaaggccctgcaaccattttggccattggtactgcaaatccagcaaaccgtgttgatcagagtacatatcctgatttctacttcaaaatcactaacagtgagcataaggttgagctcaaggagaaattccagcgcatgtgtgataaatctatgatcaagagcagatacatgtatctaacagaagagattttgaaagaaaatcctagtctgtgtgagtacatggcaccttcattggatgctaggcaagacatggttgtggttgaggtacctagacttggaaaggaggctgcagtcaaggccattaaagaatggggtcaaccaaagtcaaagattactcacttaatcttttgcaccacaagtggtgtagacatgcctggtgctgattaccaactcacaaaactcttaggtcttcgtccatacgtgaagaggtacatgatgtaccaacaag

SEQ ID NO: 51 - DNA, 582 bp, Trifolium repens
  misc_feature (18)..(18): Any nucleotide
  misc_feature (22)..(22): Any nucleotide
  misc_feature (34)..(34): Any nucleotide
acctaccttcctgttatncttnaattcatacatngcagcaaacaaagatataacatatggttagtgtatctgaaattcgcaaggctcaaagggcagaaggccctgcaactattttggccattggtactgcaaatccagcaaaccgtgttgatcaaagtacatatcctgatttctacttcaaaatcactaacagtgagcataaggttgagctcaaagagaaattccagcgcatgtgtgataaatctatgatcaagagcagatacatgtatccaacagaagagattttgaaagaaaatcctagtctttgtgaatacatggcaccttcattggatgctagacaagacatggtggtggttgaggtacctagacttggaaaggaggctgcagtgaaggccattaaagaatggggtcaaccaaaatctaagattacacatttgatcttttgcaccacaagtggtgtagacatgcctggtgctgattaccagctcacaaaactcttaggtcttcgtccatatgtgaaaaggtatatgatgtaccaacaagggtgctttgcaggtgggacggtgcttcgtttggccaagg

SEQ ID NO: 52 - DNA, 649 bp, Trifolium repens
  misc_feature (3)..(3): Any nucleotide
  misc_feature (21)..(21): Any nucleotide
  misc_feature (24)..(24): Any nucleotide
  misc_feature (26)..(26): Any nucleotide
  misc_feature (40)..(40): Any nucleotide
  misc_feature (45)..(45): Any nucleotide
  misc_feature (80)..(81): Any nucleotides
  misc_feature (238)..(239): Any nucleotides
  misc_feature (469)..(469): Any nucleotide
  misc_feature (578)..(578): Any nucleotide
  misc_feature (588)..(588): Any nucleotide
  misc_feature (600)..(600): Any nucleotide
  misc_feature (610)..(610): Any nucleotide
  misc_feature (612)..(612): Any nucleotide
  misc_feature (618)..(618): Any nucleotide
  misc_feature (620)..(620): Any nucleotide
  misc_feature (626)..(626): Any nucleotide
  misc_feature (637)..(637): Any nucleotide
  misc_feature (640)..(640): Any nucleotide
  misc_feature (649)..(649): Any nucleotide
acnacttcctgttatcacttncananattacatacatagncagcnaaacaaagatatcaacatatggttagtgtatctgnnattcgcaaggctcaaagggcagaaggccctgcaactattttggccattggtactgcaaatccagcaaaccgtgttgatcaaagtacatatcctgatttctacttcaaaatcactaacagtgagcataaggttgagctcaaagagaaattccagcgcnngtgtgataaatctatgatcaagagcagatacatgtatctaacagaagagattttgaaagaaaatcctagtctttgtgaatacatggcaccttcattggatgctagacaagacatggtggtggttgaggtacctagacttggaaaggaggctgcagtgaaggccattaaagaatggggtcaaccaaaatctaagattacacatttgatcttttgcaccacaagtggtgtanacatgcctggtgctgattaccagctcacaaaactcttaggtcttcgtccatatgtgaaaagggatatgatgtaccaacaagggtgctttgcaggtgggaccgtgcttcntttggccaangatttggcccanaacaacaaangngctcgngngttggntggttggtctnaantcaccgcan

SEQ ID NO: 53 - DNA, 521 bp, Trifolium repens
  misc_feature (2)..(2): Any nucleotide
  misc_feature (4)..(4): Any nucleotide
  misc_feature (8)..(8): Any nucleotide
tntngtcntattgaagaaactgctaagatttttaagatatggtgagtgtagctgaaattcgcaaggctcagagggctgaaggccctgcaaccattttggccattggcactgcaaatccaccaaaccgtgttgagcagagcacatatcctgatttctacttcaaaattacaaacagtgagcacaagactgagctcaaagagaagttccaacgcatgtgtgacaaatccatgatcaagagcagatacatgtatctaacagaagagattttgaaagaaaatcctagtctttgtgaatacatggcaccttcattggatgctaggcaagacatggtggtggttgaggtacctagacttgggaaggaggctgcagtgaaagctatcaaagaatggggtcaaccaaagtcaaagattactcacttaatcttttgcaccacaagtggtgtagacatgcctggagctgattaccaactcacaaaactcttaggtcttcgcccatatgtgaaaaggtatatgatgtaccaa

SEQ ID NO: 54 - DNA, 506 bp, Trifolium repens
  misc_feature (2)..(2): Any nucleotide
  misc_feature (354)..(354): Any nucleotide
  misc_feature (356)..(356): Any nucleotide
  misc_feature (368)..(368): Any nucleotide
  misc_feature (376)..(376): Any nucleotide
  misc_feature (378)..(378): Any nucleotide
  misc_feature (386)..(386): Any nucleotide
  misc_feature (434)..(434): Any nucleotide
  misc_feature (469)..(469): Any nucleotide
  misc_feature (484)..(484): Any nucleotide
  misc_feature (491)..(491): Any nucleotide
  misc_feature (503)..(503): Any nucleotide
  misc_feature (506)..(506): Any nucleotide
gngctaaagatattattaagatatggtgagtgtagctgaaattcgcaaggctcagagggctgaaggccctgcaaccattttggccattggcactgcaaatccaccaaaccgtgttgagcagagcacatatcctgatttctacttcaaaattacaaacagtgagcacaagactgagctcaaagagaagttccaacgcatgtgtgacaaatccatgatcaagagcagatacatgtatctaacagaagagattttgaaagaaaatcctagtctttgtgaatacatggcaccttcattggatgctaggcaagacatggtggtggttgaggtacctagacttgggaaggaggctgcagncnaggccattaaanaatggggncnaccaaagncaaagattactcacttaatcttttgcaccacaagtggtgctgacatgnctggtgctgattaccaactcacaaaactcttaggncttcccccatatgtnaaaaggnatatgatgcccncan

SEQ ID NO: 55 - DNA, 504 bp, Trifolium repens
  misc_feature (3)..(3): Any nucleotide
  misc_feature (9)..(11): Any nucleotides
  misc_feature (14)..(14): Any nucleotide
  misc_feature (20)..(20): Any nucleotide
  misc_feature (53)..(53): Any nucleotide
  misc_feature (374)..(374): Any nucleotide
  misc_feature (395)..(395): Any nucleotide
  misc_feature (431)..(431): Any nucleotide
  misc_feature (466)..(467): Any nucleotides
  misc_feature (473)..(473): Any nucleotide
  misc_feature (504)..(504): Any nucleotide
gtnctaaannnttnttaagnaatggtgagtgtagctgaattcgcaggctcagnaggctgaaggccctgcaaccattttggccattggcactgcaaatccaccaaaccgtgttgagcagagcacatatcctgatttctacttcaaaattacaaacagtgagcacaagactgagctcaaagagaagttccaacgcatgtgtgacaaatccatgatcaagagcagatacatgtatctaacagaagagattttgaaagaaaatcctagtctttgtgaatacatggcaccttcattggatgctaggcaagacatggtggtggttgaggtacctagacttgggaaggaggctgcagtcaaggccattaaagaatggggtnaaccaaagtgaaagattactnacttaatcttttgcaccacaagtggtgttgacatgnctggtgctgattaccaactcacaaaactcttaggnnttggcncatatgtgaaaaggtctatgatgcaccaacn

SEQ ID NO: 56 - DNA, 782 bp, Trifolium repens
gataagatattattaagatatggtgagtgtagctgaaattcgcaaggctcagagggctgaaggccctgcaaccattttggccattggcactgcaaatccaccaaaccgtgttgagcagagcacatatcctgatttctacttcaaaattacaaacagtgagcacaagactgagctcaaagagaagttccaacgcatgtgtgacaaatccatgatcaagagcagatacatgtatctaacagaagagattttgaaagaaaatcctagtctttgtgaatacatggcaccttcattggatgctaggcaagacatggtggtggttgaggtacctagacttgggaaggaggctgcagtgaaagctatcaaagaatggggtcaaccaaagtcaaagattactcacttaatcttttgcaccacaagtggtgtagacatgcctggagctgattaccaactcacaaaactcttaggtcttcgcccatatgtgaaaaggtatatgatgtaccaacaaggttgttttgcaggaggcacggtgcttcgtttggcaaaagatttggccgagaacaacaaaggtgctcgtgtgttggttgtttgttctgaagtcactgcagttacattccgtggcccgagtgacactcacttggacagtcttgttggacaagcattgtttggagatggagcagctgcacttatcgttggttctgatccagtgccagaaattgagaaaccaatatttgagatggtttggactgcacaaacaattgctccagacagtgaaggtgccattg

SEQ ID NO: 57 - DNA, 597 bp, Trifolium repens
  misc_feature (2)..(2): Any nucleotide
  misc_feature (9)..(10): Any nucleotides
  misc_feature (12)..(13): Any nucleotides
  misc_feature (15)..(15): Any nucleotide
  misc_feature (19)..(20): Any nucleotides
tnaagatanntnntnaganntggtgagtgtagcagaaattcgcaaggctcagagggctgaaggccctgcaaccattttggccattggcactgcaaatccaccaaaccgtgttgagcagagcacatatcctgatttctacttcaaaattacaaacagtgagcacaagactgagctcaaagagaagttccaacgcatgtgtgacaaatccatgatcaagagcagatacatgtatctaacagaagagattttgaaagaaaatcctagtctttgtgaatacatggcaccttcattggatgctagacaagacatggtggtggttgaggtacctagacttgggaaggaggctgcagtcaaggctatcaaagaatggggtcaaccaaaatctaagattacacatttgatcttttgcaccacaagtggtgtagacatgcctggtgctgattaccaactcacaaaactcttaggacttcgtccatatgtgaagaggtacatgatgtaccaacaagggtgctttgcaggtggggcggttcttcgtttggctaaagatttggccgagaacaacaaaggtgctcgtgtgttggttgtttgttctgaagt

SEQ ID NO: 58 - DNA, 590 bp, Trifolium repens
  misc_feature (3)..(3): Any nucleotide
  misc_feature (7)..(7): Any nucleotide
ggntcanagggctgaaggccctgcaaccttttggccgttggcactgcaaatccgcaaaccgtgttgagcagagcacatatcctgatttctacttcaaaattacaaacagtgagcacaagactgagctcaaagagaagttccaacgcatgtgtgacaaatccatgatcaagagcagatacatgtatctaacagaagagattttgaaagaaaatcctagtctttgtgaatacatggcaccttcattggatgctagacaagacatggtggtggttgaggtacctagacttgggaaggaggccgcagtcaaggctatcaaagaatggggtcaaccaaaatctaagattacacatttgatcttttgcaccacaagtggtgtagacatgcctggtgctgattaccaactcacaaaactcttaggacttcgtccatatgtgaagaggtacatgatgtaccaacaagggtgctttgcaggtgggacggttcttcgtttggctaaagatttggccgagaacaacaaaggtgctcgtgtgttggttgtttgttctgaagtaactgcagtcacattccgtggcccgagtgacactcacttg

SEQ ID NO: 59 - DNA, 618 bp, Trifolium repens
  misc_feature (13)..(13): Any nucleotide
  misc_feature (15)..(15): Any nucleotide
  misc_feature (41)..(41): Any nucleotide
  misc_feature (58)..(58): Any nucleotide
aaggccctgcaancntttttggccttggtactgcaaatccngcaaatcgtgttgaccngagtacatatcctgatttctacttcaaaatcactaacagtgagcataagattgagcttaaagagaaatttcagcgcatgtgtgataaatctatgatcaagagcagatacatgtatctaacagaagagattttgaaagaaaatcctagtctttgtgaatacatggcaccttcattggatgctaggcaagacatggtggtggttgaggtacctagacttgggaaggaggctgcagtgaaagctatcaaagaatggggtcaaccaaagtcaaagattactcacttaatcttttgcaccacaagtggtgttgacatgcctggtgctgattaccaactcacaaaactcttaggtcttcgcccatatgtgaagaggtacatgatgtaccaacaagggtgctttgcaggtgggacggttcttcgtttggccaaggatttggccgagaacaacaaaggtgctcgtgtgttggttgtttgctctgaagtaaccgcagtcacattccgcggccccagtgacactcatttggacagccttgttggacaagcactatttggagatggagctg

SEQ ID NO: 60 - DNA, 619 bp, Trifolium repens
  misc_feature (13)..(14): Any nucleotides
  misc_feature (39)..(39): Any nucleotide
ggccctgcaaccnnttttggccttggtactgcaaatccngcaaatcgtgttgaccagagtacatatcctgatttctacttcaaaatcactaacagtgagcataaggttgagcttaaagagaaatttcagcgcatgtgtgataaatctatgatcaagagcagatacatgtatctaacagaagagattttgaaagaaaatcctagtctttgtgaatacatggcaccttcattggatgctaggcaagacatggtggtggttgaggtacctagacttgggaaggaggctgcagtgaaagctatcaaagaatggggtcaaccaaagtcaaagattactcacttaatcttttgcaccacaagtggtgttgacatgcctggtgctgattaccaactcacaaaactcttaggtcttcgcccatatgtgaagaggtacatgatgtaccaacaagggtgctttgcaggtgggacggttcttcgtttggccaaggatttggccgagaacaacaaaggtgctcgtgtgttggttgtttgctctgaagtaaccgcagtcacattccgcggccccagtgacactcatttggacagccttgttggacaagcactatttggagatggagctgctg

SEQ ID NO: 61 - DNA, 559 bp, Trifolium repens
  misc_feature (27)..(28): Any nucleotides
  misc_feature (559)..(559): Any nucleotide
ataaggctgagcttaaagagaaatttnngcgcatgtgtgataaatctatgatcaagagcagatacatgtatctaacagaagagattttgaaagaaaatcctagtctttgtgaatacatggcaccttcattggatgctaggcaagacatggtggtggttgaggtacctagacttgggaaggaggctgcagtgaaagctatcaaagaatggggtcaaccaaagtcaaagattactcacttaatcttttgcaccacaagtggtgtagacatgcctggagctgattaccaactcacaaaactcttaggtcttcgcccatatgtgaagaggtacatgatgtaccaacaagggtgctttgcaggtgggacggttcttcgtttggccaaggatttggccgagaacaacaaaggtgctcgtgtgttggttgtttgctctgaagtaaccgcagtcacattccgcggccccagtgacactcatttggacagtcttgttggacaagcactattcggagatggagctgctgcactcattgttggctcagacccagtaccagaaattgagan

SEQ ID NO: 62 - DNA, 553 bp, Trifolium repens
atcaagagcagatacatgtatctaacagaagagattttgaaagaaaatcctagtctgtgtgagtacatggcaccttcattggatgctaggcaagacatggttgtggttgaggtacctagacttggaaaggaggctgcagtcaaggccattaaagaatggggtcaaccaaagtcaaagattactcacttaatcttttgcaccacaagtggtgtagacatgcctggtgctgattaccaactcacaaaactcttaggtcttcgtccatacgtgaagaggtacatgatgtaccaacaagggtgctttgcaggtgggacggtgcttcgtttggccaaggatttggccgagaacaacaaaggtgctcgtgtgttggttgtttgttctgaagtcaccgcagtcacattccgtggccctagtgacactcatttggacagtcttgttggacaagcactatttggagatggagctgctgctctcattgttggttctgatccagtaccagaaattgagaagccaatatttgagatggtatggaccgcacagacaattgctccag

SEQ ID NO: 63 - DNA, 591 bp, Trifolium repens
  misc_feature (5)..(5): Any nucleotide
  misc_feature (18)..(18): Any nucleotide
  misc_feature (22)..(22): Any nucleotide
  misc_feature (33)..(33): Any nucleotide
  misc_feature (35)..(35): Any nucleotide
gcttnaagaatggggacnaccnaaatctaagantncacatttgatcttttgcaccacaagtggtgtagacatgcctggtgctgattaccagctcacaaaactcttaggtcttcgcccatatgtgaagaggtatatgatgtatcaacaaggttgctttgcaggaggcacggtgcttcgtttggctaaagatttggccgagaacaacaaaggtgctcgtgtgctagttgtttgttctgaagtaacagcagtcacattccgcggtccaagtgacactcacttggacagtcttgttggacaagcactattcggagatggagctgctgctctcattgttggctcagaccctgtaccagaaatcgagaaacctatatttgagatggtatggaccgcacagacaattgctccggacagtgaaggtgccattgatggtcaccttcgtgaagctggactaacatttcatcttcttaaagatgttcctgggattgtatcaaagaacattaataaagcattggtcgaggctttccaaccattaggaatttctgattacaactcaatcttttggattgcacacccgggtggacctgcaattct

SEQ ID NO: 64 - DNA, 634 bp, Trifolium repens
  misc_feature (7)..(7): Any nucleotide
  misc_feature (9)..(9): Any nucleotide
  misc_feature (18)..(18): Any nucleotide
  misc_feature (26)..(26): Any nucleotide
tcttcgncnagctggacnaacatttntgcttcttaaagatgttcctgagattgtctcaaagaacattgataaggcattggttgaggcattccaaccattaaacatctctgattacaattcaatcttttggattgctcatccaggtggtcctgcaattctagaccaagttgagataaagttgggcttaaaacctgaaaaaatgaaggccaccagagatgtacttagtgaatatggtaacatgtcaagtgcatgtgtattgttcatcttagatgagatgcaaaagaaatcggctgaaaatggactgaaaaccacaggagaaggacttgactggggtgtgttgtttggatttggaccaggacttaccattgaaactgttgttctacatagtgtggctatatgagaatgcgagacttgattgttttgtattgtattgtattgtattgtattacttttaatcttgcttgaatttccatttaacaataaatatggagttcaataagtaccatcagtgttaaaataatatatcgttaatagctattattttagtgtctgtttctttttactaaactatattttattttagtatttgctattgatttgaaataaatattgtcctcttaactgaaaaaaaaaa

SEQ ID NO: 65 - protein, 132 aa, Trifolium repens
  MISC_FEATURE (3)..(3): Any amino acid
  MISC_FEATURE (6)..(6): Any amino acid
  MISC_FEATURE (9)..(9): Any amino acid
LRXAGXTFXLLKDVPEIVSKNIDKALVEAFQPLNISDYNSIFWIAHPGGPAILDQVEIKLGLKPEKMKATRDVLSEYGNMSSACVLFILDEMQKKSAENGLKTTGEGLDWGVLFGFGPGLTIETVVLHSVAI

SEQ ID NO: 66 - DNA, 491 bp, Trifolium repens
  misc_feature (7)..(7): Any nucleotide
  misc_feature (9)..(9): Any nucleotide
  misc_feature (18)..(18): Any nucleotide
  misc_feature (26)..(26): Any nucleotide
  misc_feature (429)..(429): Any nucleotide
  misc_feature (452)..(452): Any nucleotide
  misc_feature (468)..(468): Any nucleotide
  misc_feature (480)..(480): Any nucleotide
  misc_feature (482)..(482): Any nucleotide
  misc_feature (486)..(486): Any nucleotide
  misc_feature (488)..(488): Any nucleotide
  misc_feature (491)..(491): Any nucleotide
tcttcgncnagctggacnaacatttntgcttcttaaagatgttcctgagattgtctcaaagaacattgataaggcattggttgaggcattccaaccattaaacatctctgattacaattcaatcttttggattgctcatccaggtggtcctgcaattctagaccaagttgagataaagttgggcttaaaacctgaaaaaatgaaggccaccagagatgtacttagtgaatatggtaacatgtcaagtgcatgtgtattgttcatcttagatgagatgagaaagaaatcggctgaaaatggacttaaaaccacaggagaaggacttgactggggtgtgttgtttggatttgggcccggacttaccattgaaactgttgttctacatagtgtggctatatgagaatgagagacttgatttgtttttattgnattgtattactttaaatcttggntgaacttccatttaanaataagtatggngntcantntgn

SEQ ID NO: 67 - DNA, 363 bp, Trifolium repens
  misc_feature (22)..(22): Any nucleotide
gagatgcacaagaaatcggctnaaaatggactgaaaaccacaggagaaggacttgactggggtgtgttgtttggatttggaccaggacttaccattgaaactgttgttctacatagtgtggctatatgagaatgcgagacttgattgttttgtattgtattgtattgtattgtattacttttaatcttgcttgaatttccatttaacaataaatatggagttcaataagtaccatcagtgttaaaataatatatcgttaatagctattattttagtgtctgtttctttttactaaactatattttattttagtatttgctattgatttgaaataaatattgtcctcttaactgaaaaaaaaaa

SEQ ID NO: 68 - DNA, 363 bp, Trifolium repens
gagatgcctaagaaatcggctcaaaatggactgaaaaccacaggagaaggacttgactggggtgtgttgtttggatttggaccaggacttaccattgaaactgttgttctacatagtgtggctatatgagaatgcgagacttgattgttttgtattgtattgtattgtattgtattacttttaatcttgcttgaatttccatttaacaataaatatggagttcaataagtaccatcagtgttaaaataatatatcgttaatagctattattttagtgtctgtttctttttactaaactatattttattttagtatttgctattgatttgaaataaatattgtcctcttaactgaaaaaaaaaa

SEQ ID NO: 69 - DNA, 897 bp, Trifolium repens
  misc_feature (2)..(2): Any nucleotide
  misc_feature (26)..(26): Any nucleotide
  misc_feature (33)..(33): Any nucleotide
gnttcaatctgttgtgcataaaattnctttgcnatagaaaaccatacacatttgatcttgcaaagaagaaatatgggagacgaaggtatagtgagaggtgtcacaaagcagacaacccctgggaaggctactatattggctcttggcaaggcattccctcaccaacttgtgatgcaagagtatttagttgatggttattttagggacactaattgtgacaatcctgaacttaagcagaaacttgctagactttgtaagacaaccacggtaaaaacaaggtatgttgttatgaatgaggagatactaaagaaatatccagaacttgttgtcgaaggcgcctcaactgtaaaacaacgtttagagatatgtaatgaggcagtaacacaaatggcaattgaagcttcccaagtttgcctaaagaattggggtagatccttatcggacataactcatgtggtttatgtttcatctagtgaagctagattacccggtggtgacctatacttgtcaaaaggactaggactaaaccctaaaattcaaagaaccatgctctatttctctggatgctcgggaggcgtagccggccttcgcgttgcgaaagacatagctgagaacaaccctggaagtagagttttgcttgctacttctgaaactacaattattggattcaagccaccaagtgttgatagaccttatgatcttgttggtgtggcactctttggagatggtgctggtgctatgataattggctcagacccaatacttgaaactgagactccattgtttgagcttcatacttcagctcaggagtttataccagacacagagaagaaaatagatgggcggctgacggaggagggcataagtttcacgctagcgagggaactgccgcagata

SEQ ID NO: 70 - protein, 275 aa, Trifolium repens
MGDEGIVRGVTKQTTPGKATILALGKAFPHQLVMQEYLVDGYFRDTNCDNPELKQKLARLCKTTTVKTRYVVMNEEILKKYPELVVEGASTVKQRLEICNEAVTQMAIEASQVCLKNWGRSLSDITHVVYVSSSEARLPGGDLYLSKGLGLNPKIQRTMLYFSGCSGGVAGLRVAKDIAENNPGSRVLLATSETTIIGFKPPSVDRPYDLVGVALFGDGAGAMIIGSDPILETETPLFELHTSAQEFIPDTEKKIDGRLTEEGISFTLARELPQI

SEQ ID NO: 71 - DNA, 577 bp, Trifolium repens
  misc_feature (2)..(2): Any nucleotide
  misc_feature (26)..(26): Any nucleotide
  misc_feature (33)..(33): Any nucleotide
  misc_feature (43)..(43): Any nucleotide
gnttcaatctgttgtgcataaaattnctttgcnatagaaaacnctacacatttgatcttgcaaagaagaaatatgggagacgaaggtatagtgagaggtgtcacaaagcagacaacccctgggaaggctactatattggctcttggcaaggcattccctcaccaacttgtgatgcaagagtgtttagttgatggttattttagggacactaattgtgacaatcctgaacttaagcagaaacttgctagactttgtaagacaaccacggtaaaaacaaggtatgttgttatgaatgaggagatactaaagaaatatccagaacttgttgtcgaaggcgcctcaactgtaaaacaacgtttagagatatgtaatgaggcagtaacacaaatggcaattgaagcttcccaagtttgcctaaagaattggggtagatccttatcggacataactcatgtggtttatgtttcatctagtgaagctagattacccggtggtgacctatacttgtcaaaaggactaggactaaaccctaaaattcaaagaaccatgctctatttctctggatgctcgggaggcg

SEQ ID NO: 72 - DNA, 599 bp, Trifolium repens
  misc_feature (12)..(12): Any nucleotide
  misc_feature (20)..(20): Any nucleotide
  misc_feature (23)..(23): Any nucleotide
  misc_feature (30)..(30): Any nucleotide
tcaatctgttgngcattttnttnctttgcnatagaaaaccatacacatttgatcttgcttagaagaaatatgggagacgaaggtatagtgagaggtgtcacaaagcagacaacccctgggaaggctactatattggctcttggcaaggcattccctcaccaacttgtgatgcaagagtgtttagttgatggttattttagggacactaattgtgacaatcctgaacttaagcagaaacttgctagactttgtaagacaaccacggtaaaaacaaggtatgttgttatgaatgaggagatactaaagaaatatccagaacttgttgtcgaaggcgcctcaactgtaaaacaacgtttagagatatgtaatgaggcagtaacacaaatggcaattgaagcttcccaagtttgcctaaagaattggggtagatccttatcggacataactcatgtggtttatgtttcatctagtgaagctagattacccggtggtgacctatacttgtcaaaaggactaggactaaaccctaaaattcaaagaaccatgctctatttctctggatgctcgggaggcgtagccggccttcgcgttgcgaaaga

SEQ ID NO: 73 - DNA, 581 bp, Trifolium repens
  misc_feature (10)..(11): Any nucleotides
  misc_feature (19)..(19): Any nucleotide
  misc_feature (26)..(26): Any nucleotide
tctgttgtgnntaacattnctttccnttagaaaactatacacatttgatcttgcaaagaagaaatatgggagacgaaggtatagtgagaggtgtcacaaagcagacaacccctgggaaggctactatattggctcttggcaaggcattccctcaccaacttgtgatgcaagagtatttagttgatggttattttagggacactaattgtgacaatcctgaacttaagcagaaacttgctagactttgtaagacaaccacggtaaaaacaaggtatgttgttatgaatgaggagatactaaagaaatatccagaacttgttgtcgaaggcgcctcaactgtaaaacaacgtttagagatatgtaatgaggcagtaacacaaatggcaattgaagcttcccaagtttgcctaaagaattggggtagatccttatcggacataactcatgtggtttatgtttcatctagtgaagctagattacccggtggtgacctatacttgtcaaaaggactaggactaaaccctaaaattcaaagaaccatgctctatttctctggatgctcgggaggcgtagccggcctt

SEQ ID NO: 74 - DNA, 588 bp, Trifolium repens
  misc_feature (11)..(11): Any nucleotide
  misc_feature (13)..(13): Any nucleotide
  misc_feature (25)..(27): Any nucleotides
  misc_feature (36)..(36): Any nucleotide
tctgttgtgcntnaaattactttgnnntagaaaacnctacacatttgatcttgcaaagaagaaatatgggagacgaaggtatagtgagaggtgtcacaaagcagacaacccctgggaaggctactatattggctcttggcaaggcattccctcaccaacttgtgatgcaagagtgtttagttgatggttattttagggacactaattgtgacaatcctgaacttaagcagaaacttgctagactttgtaagacaaccacggtaaaaacaaggtatgttgttatgaatgaggagatactaaagaaatatccagaacttgttgtcgaaggcgcctcaactgtaaaacaacgtttagagatatgtaatgaggcagtaacacaaatggcaattgaagcttcccaagtttgcctaaagaattggggtagatccttatcggacataactcatgtggtttatgtttcatctagtgaagctagattacccggtggtgacctatacttgtcaaaaggactaggactaaaccctaaaattcaaagaaccatgctctatttctctggatgctcgggaggcgtagccggccttcgcgttg

SEQ ID NO: 75 - DNA, 563 bp, Trifolium repens
ttaacatttttttattgtagaaaatatacatttgatctagcaaagaagaaatatgggagacgaaggtatagtgagaggtgtcacaaggcagccaacccctgggaaggctactatattggctcttggcaaggcattccctcaccaacttgtgatgcaagagtatttagttgatggttattttagggacactaattgtgacaatcctaagcttaagcagaaacttgctagactttgcaagacaaccacagtgaaaacaaggtatgttgttatgaatgaagagatactaaagaaatatccagaacttactatcggaggcacctcgacggtaaaacaacatttagagatatgtaatgaggcagtaacacaaatggcaattgaagcttcccaagtttgcctaaagaattggggtagacccatatcagacataactcatgtggtttatgtttcatctagtgaagctagattacctggtggtgacctatacttgtcaaaaggactaggactaaaccctaaaattcaaagaaccatgctctatttctcgggatgctcgggaggcgtagccg

SEQ ID NO: 76 - DNA, 603 bp, Trifolium repens
  misc_feature (4)..(4): Any nucleotide
gcantagaaaaccctacacatttgatcttgcaaagaagaaatatgggagacgaatgtatagtgagaggtgtcacaaagcagacaacccctgggaaggctactatattggctcttggcaaggcattccctcaccaacttgtgatgcaagagtatttagttgatggttattttagggacactaattgtgacaatcctgaccttaagcagaaacttgctagactttgtaagacaaccacggtaaaaacaaggtatgttgttatgaatgaggagatactaaagaaatatccagaacttgttgtcgaaggcgcctcaactgtaaaacaacgtttagagatatgtaatgaggcagtaacacaaatggcaattgaagcttcccaagtttgcctaaagaattggggtagatccttatcggacataactcatgtggtttatgtttcatctagtgaagctagattacccggtggtgacctatacttgtcaaaaggactaggactaaaccctaaaattcaaagaaccatgctctatttctctggatgctcgggaggcgtagccggccttcgcgttgcgaaagacatagctgagaacaaccctggaagtagagtt

SEQ ID NO: 77 - DNA, 584 bp, Trifolium repens
  misc_feature (1)..(1): Any nucleotide
  misc_feature (5)..(5): Any nucleotide
  misc_feature (40)..(40): Any nucleotide
ntccngaacttactgtggaaggcgcctcgactgtaaaacnacgtttagagatatgtaatgaggcagtaacacaaatggcaattgaagcttcccaagtttgcctaaagaattggggtagacccttatcagacataactcatgtggtttatgtttcctctagtgaagctagattacccggtggtgacctatatttgtcaaaaggactaggactaaatcctaaaattcaaagaaccatgctctatttctctggatgctcaggaggcgtagccggccttcgcgttgcgaaagacatagctgagaacaaccctggaagtagagttttgcttgctacttctgaaactacaattattggattcaagccaccaagtgttgatagaccttatgatcttgttggtgtggcactctttggagatggtgctggtgctatgataattggctcagacccaatacttgaaactgagactccattgtttgagcttcatacttcagctcaggagtttataccagacacagagaagaaaatagatgggcggctgacggaggagggcataagtttcacgctagcgagggaactgccgcagata

SEQ ID NO: 78 - DNA, 735 bp, Trifolium repens
  misc_feature (47)..(47): Any nucleotide
gtagcaacacacactttgatttctttttgagtccttgctacgtggcnttaccaaaaaacgttgctaagtcatcaaccattccaattccttaatataacctatcagtactcaccatcttttcttcctccctgctaactttatacttagagaagatggtgaaagttaatgagatccgccaggcacagagagctgaaggccctgccactgtgttggcaatcggcactgcaactcctccaaactgtgttgatcagagtacataccccgactactacttccgcatcacaaacagtgagcacaagacagagctcaaagaaaaattccagcgcatgtgtgacaaatctatgattaagaagagatacatgcatttgacagaagagattttgaaggagaatccaagtttatgtgagtacatggcaccttcattggatgcaagacaagacatggtggttgtggaagtaccaaggctaggaaaagaggcagcaacaaaggcaatcaaggaatggggtcaacctaagtccaagattacccacctcatcttttgcaccacaagtggtgtggacatgcccggtgccgactatcagcttacaaagcttttaggccttcgtccgcatgtgaagcgttacatgatgtaccaacaaggttgttttgctggtggcacggtgcttcgtttggctaaagacttggctgaaaacaacaaaggtgcccgtgtattggtggtttgttcagagataactg

SEQ ID NO: 79 - protein, 194 aa, Trifolium repens
MVKVNEIRQAQRAEGPATVLAIGTATPPNCVDQSTYPDYYFRITNSEHKTELKEKFQRMCDKSMIKKRYMHLTEEILKENPSLCEYMAPSLDARQDMVVVEVPRLGKEAATKAIKEWGQPKSKITHLIFCTTSGVDMPGADYQLTKLLGLRPHVKRYMMYQQGCFAGGTVLRLAKDLAENNKGARVLVVCSEIT

SEQ ID NO: 80 - DNA, 574 bp, Trifolium repens
  misc_feature (47)..(47): Any nucleotide
gtagcaacacacactttgatttctttttgagtccttgctacgtggcnttaccaaaaaacgttgctcactcatcaaccattccaattccttaatataacctatcagtacttaccatcttttcttcctccctgctaactttagaatcagagaagatggtgaatgttaatgagatccgccaggcacagagagctgaaggccctgccactgtgttggcaatcggcactgcaactcctccaaactgtgtcgatcagagtacatacccggactactacttccgcatcacaaacagtgagcacaagacagagctcaaagaaaaattccagcgcatgtgtgacaaatctatgattaagaagagatacatgcatttgacagaagagattttgaaggagaatccaagtttatgtgagtacatggcaccttcattggatgcaagacaagacatggtggttgtggaagtaccaaggctaggaaaagaggcagcaacaaaggcaattaaggaatggggtcaacctaagtccaagattacccacctcatcttttgcaccaccagtggtgtcgacatgcccggtgccgc

SEQ ID NO: 81 - DNA, 597 bp, Trifolium repens
gtagcaacacacactttgatttctttttgagtccttgctacgtggctttaccaaaaaacgttgctaagtcatcaaccattccaattccttaatataacctatcagtactcaccatcttttcttcctccctgctaactttagactcagagaagatggtgaatgttaatgagatccgccaggcacagagagctgaaggccctgccaccgtgttggcaatcggcactgcaactcctccaaactgtgtcgatcagagtacatacccagactactacttccgcatcacaaacagtgagcacaagacagagctcaaagaaaaattccagcgcatgtgtgacaaatctatgattaagaagagatacatgcatttgacagaagagattttgaaggagaatccaagtttatgtgagtacatggcaccttcattggatgcaagacaagacatggtggttgtggaagtaccaaggctaggaaaagaggctgcaacaaaggctatcaaggaatggggtcaacctaagtccaagattactcacctcatcttttgcaccacaagtggtgtggacatgcctggcgccgactatcagcttacaaagcttttag

SEQ ID NO: 82 - DNA, 616 bp, Trifolium repens
  misc_feature (70)..(70): Any nucleotide
  misc_feature (616)..(616): Any nucleotide
gtagcaacacacactttgatttctttttgagtccttgctacgtggctttaccaaaaaacgttgctaagtnatcaaccattccaattccttaatataacctatcagtactcaccatcttttcttcctccctgctaactttagactcagagaagatggtgaatgttaatgagatccgccaggcacagagagctgaaggccctgccaccgtgttggcaatcggcactgcaactcctccaaactgtgtcgatcagagtacatacccagactactacttccgcatcacaaacagtgagcacaagacagagctcaaagaaaaattccagcgcatgtgtgacaaatctatgattaagaagagatacatgcatttgacagaagagattttgaaggagaatccaagtttatgtgagtacatggcaccttcattggatgcaagacaagacatggtggttgtggaagtaccaaggctaggaaaagaggctgcaacaaaggctatcaaggaatggggtcaacctaagtccaagattactcacctcatcttttgcaccacaagtggtgtggacatgcctggcgccgactatcagcttacaaagcttttaggccttcgtccgcatgtgan

SEQ ID NO: 83 - DNA, 585 bp, Trifolium repens
  misc_feature (1)..(3): Any nucleotides
  misc_feature (7)..(7): Any nucleotide
  misc_feature (20)..(20): Any nucleotide
  misc_feature (37)..(37): Any nucleotide
  misc_feature (61)..(61): Any nucleotide
  misc_feature (451)..(451): Any nucleotide
  misc_feature (507)..(507): Any nucleotide
nnncacncacacttttttgnatccctgctacgtggcnttaccaaaaaacgttgctaagtcntcaaccattccaattccttaatataacctatcagtactcaccatcttttcttcctccctgctaactttagactcagagaagatggtgaatgttaatgagatccgccaggcacagagagctgaaggccctgccaccgtgttggcaatcggcactgcaactcctccaaactgtgttgatcagagtacatacccggactactacttccgcatcacaaacagtgagcacaagacagagctcaaagaaaaattccagcgcatgtgtgacaaatctatgattaagaagagatacatgcatttaacagaagagattttgaaggagaatccaagtttatgtgagtacatggcaccttcattggatgcaagacaagacatggtggttgtggaagtaccnaggctaggaaaagaggcagtaacaaaggcaattagggaatggggtcaacctaagtncaagattacccacctcatcttttgcaccaccagtggtgtggacatgcccggtgccgactatcagctcacaaagctctt

SEQ ID NO: 84 - DNA, 596 bp, Trifolium repens
  misc_feature (3)..(3): Any nculeotide
  misc_feature (14)..(14): Any nculeotide
  misc_feature (37)..(37): Any nculeotide
ttnatcccctaatntagttttcttctttgttacttanagaatatggttacagttaatgagatccgccaggcacagagagctgaaggccctgcaactgtgtttgcaatcggcactgcaactcctaaaaactgtgttgatcagagtacttaccccgactactatttccgaatcacaaacagcgaacacaagactgaactcaaagaaaaattccagcgcatgtgtgacaaatctatgattaagaagagatacatgcatttgacagaagagattttgaaggagaattcaagtttatgtgagtacatggcaccttcattggatgcaagacaagacatggtggttgtggaagtaccaaggctaggaaaagaggctgcaacaaaggctatcaaggaatggggtcaacctaagtccaagattactcacctcatcttttgcaccacaagtggtgtggacatgcctggtgccgactatcagcttacaaagcttttaggccttcgtccgcatgtgaagcgttatatgatgtaccaacaaggttgttttgctggtggcacggtgcttcgtttggctaaagacttggctgaaaacaacaaaggtgcccg

SEQ ID NO: 85 - DNA, 618 bp, Trifolium repens
  misc_feature (3)..(3): Any nucleotide
  misc_feature (6)..(6): Any nucleotide
  misc_feature (9)..(9): Any nucleotide
  misc_feature (14)..(14): Any nucleotide
  misc_feature (37)..(37): Any nucleotide
ttnatnccntaatntagttttcttctttgttacttanagaatatggttacagttaatgagatccgccaggcacagagagctgaaggccctgcaactgtgtttgcaatcggcactgcaactcctaaaaactgtgttgatcagagtacttaccccgactactatttccgaatcacaaacagcgaacacaagactgaactcaaagaaaaattccagcgcatgtgtgacaaatctatgattaagaagagatacatgcatttgacagaagagattttgaaggagaattcaagtttatgtgagtacatggcaccttcattggatgcaagacaagacatggtggttgtggaagtaccaaggctaggaaaagaggctgcaacaaaggctatcaaggaatggggtcaacctaagtccaagattactcacctcatcttttgcaccacaagtggtgtggacatgcctggtgccgactatcagcttacaaagcttttaggccttcgtccgcatgtgaagcgttatatgatgtaccaacaaggttgttttgctggtggcacggtgcttcgtttggctaaagacttggctgaaaacaacaaaggtgcccgtgtattggtggtttgttcagag

SEQ ID NO: 86 - DNA, 609 bp, Trifolium repens
  misc_feature (4)..(4): Any nucleotide
  misc_feature (10)..(10): Any nucleotide
  misc_feature (32)..(33): Any nucleotides
tccnataatntagttttcttctttgttacttnnagaatatggttacagttaatgagatccgccaggcacagagagctgaaggccctgcaactgtgtttgcaatcggcactgcaactcctaaaaactgtgttgatcagagtacttaccccgactactatttccgaatcacaaacagcgaacacaagactgaactcaaagaaaaattccagcgcatgtgtgacaaatctatgattaagaagagatacatgcatttgacagaagagattttgaaggagaattcaagtttatgtgagtacatggcaccttcattggatgcaagacaagacatggtggttgtggaagtaccaaggctaggaaaagaggctgcaacaaaggctatcaaggaatggggtcaacctaagtccaagattactcacctcatcttttgcaccacaagtggtgtggacatgcctggtgccgactatcagcttacaaagcttttaggccttcgtccgcatgtgaagcgttatatgatgtaccaacaaggttgttttgctggtggcacggtgcttcgtttggctaaagacttggctgaaaacaacaaaggtgcccgtgtattggtggtttgtt

SEQ ID NO: 87 - DNA, 571 bp, Trifolium repens
  misc_feature (3)..(4): Any nucleotides
  misc_feature (14)..(14): Any nucleotide
  misc_feature (18)..(19): Any nucleotides
  misc_feature (22)..(22): Any nucleotide
  misc_feature (60)..(60): Any nucleotide
  misc_feature (87)..(87): Any nucleotide
  misc_feature (89)..(89): Any nucleotide
  misc_feature (91)..(91): Any nucleotide
  misc_feature (247)..(247): Any nucleotide
  misc_feature (571)..(571): Any nucleotide
gcnntaacctttanaatnnganaagatggtgaaagttaatgagatccgccaggcacaganagctgaaggccctgccactgtgttggnantnggcactgcaactcctccaaactgtgtcgatcagagtacatacccggactactacttccgcatcacaaacagtgagcacaagacagagctcaaagaaaaattccagcgcatgtgtgacaaatctatgattaagaagagatacatgcatttgacagangagattttgaaggagaatccaagtttatgtgagtacatggcaccttcattggatgcaagacaagacatggtggttgtggaagtaccaaggctaggaaaagaggcagcaacaaaggcaattaaggaatggggccaacctaagtccaagattacccacctcatcttttgcaccaccagtggtgtcgacatgcccggtgccgactatcagctcacaaagctcttaggcctgcgtccatatgtgaagcgttacatgatgtatcaacaaggttgttttgctggtggcacggtgcttcgtttggctaaagacttggctgaaaacaacaan

SEQ ID NO: 88 - DNA, 603 bp, Trifolium repens
  misc_feature (2)..(4): Any nucleotides
  misc_feature (9)..(9): Any nucleotide
  misc_feature (13)..(14): Any nucleotides
  misc_feature (32)..(32): Any nucleotide
  misc_feature (567)..(567): Any nucleotide
  misc_feature (594)..(594): Any nucleotide
tnnntttanaatnngagaagatggtgaaagtnaatgagatccgccaggcacagagagctgaaggccctgccactgtgttggcaatcggcactgcaactcctccaaactgtgtcgatcagagtacatacccggactactacttccgcatcacaaacagtgagcacaagacagagctcaaagaaaaattccagcgcatgtgtgacaaatctatgattaagaagagatacatgcatttgacagaagagattttgaaggagaatccaagtttatgtgagtacatggcaccttcattggatgcaagacaagacatggtggttgtggaagtaccaaggctaggaaaagaggcagcaacaaaggcaattaaggaatggggccaacctaagtccaagattacccacctcatcttttgcaccaccagtggtgtcgacatgcccggtgccgactatcagctcacaaagctcttaggcctgcgtccatatgtgaagcgttacatgatgtatcaacaaggttgttttgctggtggcacggtgcttcgtttggctaaagacttggctgaaaacaacaaangtgcccgtgtgttggtgggttgttcanagataactg

SEQ ID NO: 89 - DNA, 588 bp, Trifolium repens
  misc_feature (7)..(7): Any nucleotide
  misc_feature (12)..(12): Any nucleotide
  misc_feature (43)..(43): Any nucleotide
  misc_feature (68)..(68): Any nucleotide
tttgttnattgnagaatatggttacagttaatgagatccgccnggcacaaagagccgaaggccctgcncctgtgtttgcaatcggcactgcaactcctaaaaactgtgttgatcagagtacttaccccgactactatttccgaatcacaaacagcgaacacaagactgagctcaaagaaaaattccagcgcatgtgtgacaaatctatgattaagaagagatacatgcatttgacagaagagattttgaaggagaatccaagtttatgtgagtacatggcaccttcattggatgcaagacaagacatggtggtagtggaagtaccaaggctaggaaaagaggcagcaacaaaggcaattaaagaatggggtcaacctaagtccaagattacccacctcatcttttgcaccaccagtggtgtggacatgcccggtgccgactatcagctcacaaagctcttaggcctgcgtccatatgtgaagcgttacatgatgtatcaacaaggttgttttgctggtggcacggtacttcgtttggctaaagacttggctgaaaacaacaaaggtgcccgtgtgttggtggtttgtt

SEQ ID NO: 90 - DNA, 250 bp, Trifolium repens
  misc_feature (17)..(17): Any nucleotide
  misc_feature (35)..(35): Any nucleotide
  misc_feature (48)..(49): Any nucleotides
  misc_feature (165)..(165): Any nucleotide
  misc_feature (188)..(188): Any nucleotide
  misc_feature (212)..(212): Any nucleotide
  misc_feature (224)..(225): Any nucleotides
  misc_feature (228)..(228): Any nucleotide
  misc_feature (232)..(232): Any nucleotide
  misc_feature (235)..(235): Any nucleotide
  misc_feature (240)..(240): Any nucleotide
  misc_feature (247)..(247): Any nucleotide
  misc_feature (250)..(250): Any nucleotide
taaaactgtgttgatcngagtacttaccccgactnctatttccgaatnncaaacagcgaacacaagactgagctcaaagaaaaattccagcgcatgtgtgacaaatctatgattaagaagagatacatgcatttgacagaagagattttgaaggagaatccaagnttatgtgagtacatggcaccttnattggatgcaagacaagacatggnggccgcccaccnnccntccnccncaccncaacccnccn

SEQ ID NO: 91 - DNA, 583 bp, Trifolium repens
  misc_feature (2)..(2): Any nucleotide
  misc_feature (47)..(47): Any nucleotide
  misc_feature (552)..(552): Any nucleotide
gnagcaacacacactttgatttctttttgaatccctgctacgtggcncaccaaaaaacgttgctaagtcatcaaccattccaattccttaatataacctatcagtactcaccatcttttcttcctccctgctaactttagactcagtagaagatggtgaatgttaatgagatccgccaggcacagagagctgaaggccctgccaccgtgttggcaatcggcactgcaactcctccaaactgtgttgatcagagtacatacccggactactacttccgcatcacaaacagtgagcacaagacagagctcaaagaaaaattccagcgcacgtgtaagatatttatcttatactccatgcatgtctttttctgctgactgccgtgtttatatattgttttgttttgttccttaaatttgttatgtcactctcacatgtacaaaacacttaagactaaactgcatatcatttttttcagggacaaatctatgattaagaagagatacatgcatttgacagaagagattttgaaggagaatccaagtttatgtgagnacatggcaccttcttgggatgcaagacaagt

SEQ ID NO: 92 - protein, 95 aa, Trifolium repens
  MISC_FEATURE (86)..(86): Any amino acid
MVNVNEIRQAQRAEGPATVLAIGTATPPNCVDQSTYPDYYFRITNSEHKTELKEKFQRTRDKSMIKKRYMHLTEEILKENPSLCEXMAPSWDARQ

SEQ ID NO: 93 - DNA, 582 bp, Trifolium repens
  misc_feature (2)..(2): Any nucleotide
  misc_feature (551)..(551): Any nucleotide
gnagcaacacacactttgatttctttttgaatccctgctacgtggcttaccaaaaaacgttgctaagtcatcaaccattccaattccttaatataacctatcagtactcaccattttttcttcctccctgctaactttagactcagagaagatggtgaatgttaatgagatccgccaggcacagagagctgaaggccctgccaccgtgttggcaatcggcactgcaactcctccaaactgtgttgatcagagtacatacccggactactacttccgcatcacaaacagtgagcacaagacagagctcaaagaaaaattccagcgcacgtgtaagatatttatcttatactccatgcatgtctttttctgctgactgccgtgtttatatattgttttgttttgttccttaaatttgttatgtcactctcacatgtacaaaacacttaagactaaactgcatatcatttttttcagggacaaatctatgattaagaagagatacatgcatttgacagaagagattttgaaggagaatccaagtttatgtgagnacatggcaccttcttgggatgcaagacaagt

SEQ ID NO: 94 - DNA, 167 bp, Trifolium repens
  misc_feature (17)..(17): Any nucleotide
  misc_feature (34)..(34): Any nucleotide
  misc_feature (38)..(38): Any nucleotide
gtccctgctgcgtggcncaccaaaaacgttgctnagtntgaaccttccattccttaatataacctatcagtactcaccatcttttcttcctccctgctaactttagactcagtagaagatggtgaatgttaatgagatccgccaggcacagagagctgaaggccctg

SEQ ID NO: 95 - DNA, 613 bp, Trifolium repens
  misc_feature (3)..(3): Any nucleotide
  misc_feature (16)..(16): Any nucleotide
gcntaagccttgattnttgtttgtttcctaacacaagaactagtgtttgcttgaatcttaagaaaaaatgcctcaaggtgatttgaatggaagttcctcggtgaatggagcacgtgctagacgtgctcctactcagggaaaggcaacgatacttgcattaggaaaggctttccccgcccaagtcctccctcaagagtgcttggtggaaggattcattcgcgacactaagtgtgacgatacttatattaaggagaaattggagcgtctttgcaaaaacacaactgtaaaaacaagatacacagtaatgtcaaaggagatcttagacaactatccagagctagccatagatggaacaccaacaataaggcaaaagcttgaaatagcaaatccagcagtagttgaaatggcaacaagagcaagcaaagattgcatcaaagaatggggaaggtcacctcaagatatcacacacatagtctatgtttcctcgagcgaaattcgtctacccggtggtgacctttatcttgcaaatgaactcggcttaaacagcgatgttaatcgcgtaatgctctatttcctcggttgctacggcggtgtcactggcttacgtgtcgcc

SEQ ID NO: 96 - protein, 182 aa, Trifolium repens
MPQGDLNGSSSVNGARARRAPTQGKATILALGKAFPAQVLPQECLVEGFIRDTKCDDTYIKEKLERLCKNTTVKTRYTVMSKEILDNYPELAIDGTPTIRQKLEIANPAVVEMATRASKDCIKEWGRSPQDITHIVYVSSSEIRLPGGDLYLANELGLNSDVNRVMLYFLGCYGGVTGLRVA

SEQ ID NO: 97 - DNA, 613 bp, Trifolium repens; identical to SEQ ID NO: 95
  misc_feature (3)..(3): Any nucleotide
  misc_feature (16)..(16): Any nucleotide

SEQ ID NO: 98 - DNA, 570 bp, Trifolium repens
  misc_feature (13)..(13): Any nucleotide
taagccttgattnttgtttgtttcctaacacaagaactagtgtttgcttgaatcttaagaaaaaatgcctcaaggtgatttgaatggaagttcctcggtgaatggagcacgtgctagacgtgctcctactcagggaaaggcaacgatacttgcattaggaaaggctttccccgcccaggtcctccctcaagagtgcttggtggaaggattcattcgcgacactaagtgtgacgatacttatattaaggagaaattggagcgtctttgcaaaaacacaactgtgaaaacaagatacacagtaatgtcaaaggagatcttagacaactatccagagctagccatagatggaacaccaacaataaggcaaaagcttgaaatagcaaatccagcagtagttgaaatggcaacaagagcaagcaaagattgcatcaaagaatggggaaggtcacctcaagatatcacacacatagtctatgtttcctcgagcgaaattcgtctacccggtggtgacctttatcttgcaaatgaactcggcttaaacagcgatgttaatcgcgtaatgctctattt

SEQ ID NO: 99 - DNA, 575 bp, Trifolium repens
  misc_feature (33)..(33): Any nucleotide
ttgattcttgtttgtttcctaacacaagaactngtgtttgcttgaatcttaagaaaaaatgcctcaaggtgatttgaatggaagttcctcggtgaatggagcacgtgctagacgtgctcctactcagggaaaggcaacgatacttgcattaggaaaggctttccccgcccaggtcctccctcaagagtgcttggtggaaggattcattcgcgacactaagtgtgacgatacttatattaaggagaaattggagcgtctttgcaaaaacacaactgtgaaaacaagatacacagtaatgtcaaaggagatcttagacaactatccagagctagccatagatggaacaccaacaataaggcaaaagcttgaaatagcaaatccagcagtagttgaaatggcaacaagagcaagcaaagattgcatcaaagaatggggaaggtcacctcaagatatcacacacatagtctatgtttcctcgagcgaaattcgtctacccggtggtgacctttatcttgcaaatgaactcggcttaaacagcgatgttaatcgcgtaatgctctatttcctcggttgct

SEQ ID NO: 100 - DNA, 573 bp, Trifolium repens
gtttgtttcctaacacaagaactagtgtttgcttgaatcttaagaaaaaatgcctcaaggtgatttgaatggaagttcctcggtgaatggagcacgtgctagacgtgctcctactcagggaaaggcaacgatacttgcattaggaaaggctttccccgcccaagtcctccctcaagagtgcttggtggaaggattcattcgcgacactaagtgtgacgatacttatattaaggagaaattggagcgtctttgcaaaaacacaactgtaaaaacaagatacacagtaatgtcaaaggagatcttagacaactatccagagctagccatagatggaacaccaacaataaggcaaaagcttgaaatagcaaatccagcagtagttgaaatggcaacaagagcaagcaaagattgcatcaaagaatggggaaggtcacctcaagatatcacacacatagtctatgtttcctcgagcgaaattcgtctacccggtggtgacctttatcttgcaaatgaactcggcttaaacagcgatgttaatcgcgtaatgctctatttcctcggttgctacggcgg

SEQ ID NO: 101 - DNA, 607 bp, Trifolium repens
gtataccaaggttgttttgctggtggcacggtacttcgtttggctaaagacttggctgaaaacaacaaaggtgcccgtgtgttggtggtttgttcagagataactgcagttactttccgtggacccagtgacactcaccttgatagccttgtggggcaagcattgtttggagatggtgcagcagctgtgattgttggttcagaccctttgccagaagttgagaagcctttgtttgaattggtatggaccgcacaaacaatcgctccagatagtgaaggagccattgatggtcaccttcgcgaagcagggctgacattccatctcctcaaggatgttcctagccttgtctcaaataacattgagaaagcgcttgttgatgcctttcaacctttgaatatttctgactacaattccatcttttggattgcacacccaggcggaccagcaattcttgaccaagttgaagctaagttaggcttaaagccagagaaaatgcaagccactcgacatgtacttagcgaatatggtaacatgtcaagtgcgtgtgtgttatttatcttggatgagatgaggaggaagtcaaaagaagacggacttgccacaacag

SEQ ID NO: 102 - protein, 202 aa, Trifolium repens
VYQGCFAGGTVLRLAKDLAENNKGARVLVVCSEITAVTFRGPSDTHLDSLVGQALFGDGAAAVIVGSDPLPEVEKPLFELVWTAQTIAPDSEGAIDGHLREAGLTFHLLKDVPSLVSNNIEKALVDAFQPLNISDYNSIFWIAHPGGPAILDQVEAKLGLKPEKMQATRHVLSEYGNMSSACVLFILDEMRRKSKEDGLATT

SEQ ID NO: 103 - DNA, 607 bp, Trifolium repens
  misc_feature (12)..(12): Any nucleotide
  misc_feature (46)..(46): Any nucleotide
gtataccaaggntgttttgctggtggcacggtacttcgtttggctnaagacttggctgaaaacaacaaaggtgcccgtgtgttggtggtttgttcagagataactgcagttactttccgtggacccagtgacactcatcttgatagccttgtggggcaagcattgtttggagatggtgcagcagctgtgattgttggttcagaccctttgccagaagttgagaagcctttgtttgaattggtatggaccgcacaaacaatcgctccagatagtgaaggagccattgatggtcaccttcgcgaagcagggctgacattccatctcctcaaggatgttcctagccttgtctcaaataacattgagaaagctcttgttgatgcctttcaacctttgaatatctccgattacaattccatcttttggattgcacacccaggcggaccagcaattcttgaccaagttgaagctaagttaggcttaaagccagagaaaatgcaatccactcgacatgtacttagcgaatatggtaacatgtcgagtgcgtgtgtgttatttatcttggatgagatgaggaggaagtcaaaagaagacggacttgccacaacag

SEQ ID NO: 104 - DNA, 591 bp, Trifolium repens
  misc_feature (562)..(562): Any nucleotide
  misc_feature (587)..(587): Any nucleotide
  misc_feature (589)..(589): Any nucleotide
ccaaggttgttttgctggtggcacggtacttcgtttggctaaagacttggctgaaaacaacaaaggtgcccgtgtgttggtggtttgttcagagataactgcagttactttccgtggacccagtgacactcaccttgatagccttgtggggcaagcattgtttggagatggtgcagcagctgtgattgttggttcagaccctttgccagaagttgagaagcctttgtttgaattggtatggaccgcacaaacaatcgctccagatagtgaaggagccattgatggtcaccttcgcgaagcagggctgacattccatctcctcaaggatgttcctagccttgtctcaaataacattgagaaagcgcttgttgatgcctttcaacctttgaatatttctgactacaattccatcttttggattgcacacccaggcggaccagcaattcttgaccaagttgaagctaagttaggcttaaagccagagaaaatgcaagccactcgacatgtacttagcgaatatggtaacatgtcaagtgcgtgtgtgttatttatcttggatganatgaggaggaagtcaaaagaacacngnct

SEQ ID NO: 105 - DNA, 590 bp, Trifolium repens
  misc_feature (55)..(55): Any nucleotide
ggttgttttgctggtggcacggtacttcgtttggctaaagacttggctgaaaacnacaaaggtgcccgtgtgttggtggtttgttcagagataactgcagttactttccgtggacccagtgacactcaccttgatagccttgtggggcaagcattgtttggagatggtgcagcagctgtgattgttggttcagaccctttgccagaagttgagaagcctttgtttgaattggtatggaccgcacaaacaatcgctccagatagtgaaggagccattgatggtcaccttcgcgaagcagggctgacattccatctcctcaaggatgttcctagccttgtctcaaataacattgagaaagcgcttgttgatgcctttcaacctttgaatatttctgactacaattccatcttttggattgcacacccaggcggaccagcaattcttgaccaagttgaagctaagttaggcttaaagccagagaaaatgcaagccactcgacatgtacttagcgaatatggtaacatgtcaagtgcgtgtgtgttatttatcttggatgagatgaggaggaagtcaaaagaagacggacttgc

SEQ ID NO: 106 - DNA, 510 bp, Trifolium repens
  misc_feature (4)..(4): Any nucleotide
  misc_feature (10)..(10): Any nucleotide
  misc_feature (12)..(12): Any nucleotide
  misc_feature (14)..(14): Any nucleotide
  misc_feature (397)..(397): Any nucleotide
  misc_feature (417)..(417): Any nucleotide
  misc_feature (437)..(437): Any nucleotide
  misc_feature (458)..(458): Any nucleotide
  misc_feature (496)..(496): Any nucleotide
aatnacaccntnanaccttccaattctcgtacctcaccaatctcatttttattatatatcttggtacatcttttgttacctccaacaaaaaaatggtgaccgtagaagagattcgtaacgcccaacgttcaaatggccctgccactatcttagcttttggcacagccactccttctaactgtgtcactcaagctgattatcctgattactactttcgtatcaccaacagcgaacatatgactgatcttaaggaaaaattcaagcggatgtgtgatagatcaatgataaagaaacgttacatgcacctaacagaagactttctgaaggagaatccaaatatgtgtgaatacatggcaccatcactagatgtaagacgagacatagtggttgttgaagnaccaaagctaggtaaagaancaccaaaaaaagccatatgngaatggggacaaccaaaatcnaaaatcacacatgcttggtttctgaccacttccggtgntgacatgcccgggg

SEQ ID NO: 107 - protein, 137 aa, Trifolium repens
  MISC_FEATURE (102)..(102): Any amino acid
  MISC_FEATURE (114)..(114): Any amino acid
  MISC_FEATURE (121)..(121): Any amino acid
MVTVEEIRNAQRSNGPATILAFGTATPSNCVTQADYPDYYFRITNSEHMTDLKEKFKRMCDRSMIKKRYMHLTEDFLKENPNMCEYMAPSLDVRRDIVVVEXPKLGKEPKKAIXEWGQPKXKITHAWFLTTSGDMPG

SEQ ID NO: 108 - DNA, 240 bp, Trifolium repens
  misc_feature (10)..(10): Any nucleotide
  misc_feature (129)..(129): Any nucleotide
  misc_feature (162)..(162): Any nucleotide
  misc_feature (184)..(184): Any nucleotide
  misc_feature (194)..(194): Any nucleotide
  misc_feature (217)..(218): Any nucleotides
  misc_feature (231)..(231): Any nucleotide
gacaaatgcntgtggttggaatgggatccgcacctgattttacatgtaagaaagacacaaaagatgcaatcgttgaagccatcaaacaaggttatagacactttgatactgctgctgcttatggctcanaacaagctcttggtgaaggtttgaaagaagcanttgaacttggtcttgtcactanagaagagctntttgttacttctaaactttgggnnactgaaaatcatnctaaccttg

SEQ ID NO: 109 - protein, 79 aa, Trifolium repens
  MISC_FEATURE (3)..(3): Any amino acid
  MISC_FEATURE (43)..(43): Any amino acid
  MISC_FEATURE (54)..(54): Any amino acid
  MISC_FEATURE (61)..(61): Any amino acid
  MISC_FEATURE (64)..(64): Any amino acid
  MISC_FEATURE (72)..(72): Any amino acid
  MISC_FEATURE (77)..(77): Any amino acid
QMXVVGMGSAPDFTCKKDTKDAIVEAIKQGYRHFDTAAAYGSXQALGEGLKEAXELGLVTXEEXFVTSKLWXTENHXNL

SEQ ID NO: 110 - DNA, 604 bp, Trifolium repens
  misc_feature (13)..(13): Any nucleotide
gtgtagcagagtnagaaaaagagagaaaaaaaaacatggcaggaaagaaaatcccagaagtgttattgaattcaggacacaaaatgccagtcataggaatgggaacatcagtagacaatcgtccatcaaatgatgttcttgcttcaatctttgttgatgcaattgaagttggttatcgccatttcgattctgcttctgtgtatggaacagaggaagccataggaattgctttagcaaaagctttagaaaaagggcttattaagagtagagatgaagttttcatcacttcaaagccatggaatactgatgcagattatgaacttattgttccagctctcaagaccacattgaaaaagctggggacggagtatgtggatctttatctgatccattggccagtgagacttagacatgatcttgaaaaccctgttgttttcaccaaagaagatttacttccctttgatatagaagggacatggaaagctatggaagaatgttataagttaggcttagcaaagtctattggtatatgcaattatggtaccaaaaaactcaccaaactcttggaaacagccaccattacccctgcagtcaatcaggtgga

SEQ ID NO: 111 - protein, 189 aa, Trifolium repens
MAGKKIPEVLLNSGHKMPVIGMGTSVDNRPSNDVLASIFVDAIEVGYRHFDSASVYGTEEAIGIALAKALEKGLIKSRDEVFITSKPWNTDADYELIVPALKTTLKKLGTEYVDLYLIHWPVRLRHDLENPVVFTKEDLLPFDIEGTWKAMEECYKLGLAKSIGICNYGTKKLTKLLETATITPAVNQV

SEQ ID NO: 112 - DNA, 334 bp, Trifolium repens
  misc_feature (10)..(10): Any nucleotide
  misc_feature (17)..(17): Any nucleotide
  misc_feature (21)..(21): Any nucleotide
  misc_feature (246)..(246): Any nucleotide
  misc_feature (268)..(268): Any nucleotide
  misc_feature (277)..(277): Any nucleotide
  misc_feature (281)..(281): Any nucleotide
  misc_feature (294)..(294): Any nucleotide
  misc_feature (328)..(328): Any nucleotide
  misc_feature (330)..(330): Any nucleotide
  misc_feature (334)..(334): Any nucleotide
gtgtagcagnattaganaaanatataaaaaaaaacatggcaggaaagaaaatcccagaagtgttattgaattcaggacacaaaatgccagtcataggaatgggaacatcagtagacaatcgtccatcaaatgatgttcttgcttcaatctttgttgatgcaattgaagttggttatcgccatttcgattctgcttctgtgtatggaacagaggaagccataggaattgctttagcaaaagctttanaaaaagggcttattaagagtanagatgaagntttnatcacttgcaagncatggaatactgatgcacattatgaacttattgntncaan

SEQ ID NO: 113 - DNA, 602 bp, Trifolium repens
  misc_feature (8)..(8): Any nucleotide
  misc_feature (14)..(14): Any nucleotide
  misc_feature (16)..(16): Any nucleotide
  misc_feature (20)..(20): Any nucleotide
  misc_feature (22)..(22): Any nucleotide
gtagcagngttagnanaagngngaaaaaaaaacatggcaggaaagaaaatcccagaagtgttattgaattcaggacacaaaatgccagtcataggaatgggaacatcagtagacaatcgtccatcaaatgatgttcttgcttcaatctttgttgatgcaattgaagttggttatcgccatttcgattctgcttctgtgtatggaacagaggaagccataggaattgctttagcaaaagctttagaaaaagggcttattaagagtagagatgaagttttcatcacttcaaagccatggaatactgatgcagattatgaacttattgttccagctctcaagaccacattgaaaaagctggggacggagtatgtggatctttatctgatccattggccagtgagacttagacatgatcttgaaaaccctgttgttttcaccaaagaagatttacttccctttgatatagaagggacatggaaagctatggaagaatgttataagttaggcttagcaaagtctattggtatatgcaattatggtaccaaaaaactcaccaaactcttggaaacagccaccattacccctgcagtcaatcaggtgga

SEQ ID NO: 114 - DNA, 584 bp, Trifolium repens
  misc_feature (4)..(5): Any nucleotides
  misc_feature (27)..(27): Any nucleotide
agtnngaaaaagagagaaaaaaaaacntggcaggaaagaaaatcccagaagtgttattgaattcaggacacaaaatgccagtcataggaatgggaacatcagtagacaatcgtccatcaaatgatgttcttgcttcaatctttgttgatgcaattgaagttggttatcgccatttcgattctgcttctgtgtatggaacagaggaagccataggaattgctttagcaaaagctttagaaaaagggcttattaagagtagagatgaagttttcatcacttcaaagccatggaatactgatgcagattatgaacttattgttccagctctcaagaccacattgaaaaagctggggacggagtatgtggatctttatctgatccattggccagtgagacttagacatgatcttgaaaaccctgttgttttcaccaaagaagatttacttccctttgatatagaagggacatggaaagctatggaagaatgttataagttaggcttagcaaagtctattggtatatgcaattatggtaccaaaaaactcaccaaactcttggaaacagccaccattacccctgcagtc

SEQ ID NO: 115 - DNA, 547 bp, Trifolium repens
  misc_feature (4)..(5): Any nucleotides
  misc_feature (27)..(27): Any nucleotide
agtnngaaaaagagagaaaaaaaaacntggcaggaaagaaaatcccagaagtgttattgaattcaggacacaaaatgccagtcataggaatgggaacatcagtagacaatcgtccatcaaatgatgttcttgcttcaatctttgttgatgcaattgaagttggttatcgccatttcgattctgcttctgtgtatggaacagaggaagccataggaattgctttagcaaaagctttagaaaaagggcttattaagagtagagatgaagttttcatcacttcaaagccatggaatactgatgcagattatgaacttattgttccagctctcaagaccacattgaaaaagctggggacggagtatgtggatctttatctgatccattggccagtgagacttagacatgatcttgaaaaccctgttgttttcaccaaagaagatttacttccctttgatatagaagggacatggaaagctatggaagaatgttataagttaggcttagcaaagtctattggtatatgcaattatggtaccaaaaaactcac

SEQ ID NO: 116 - DNA, 334 bp, Trifolium repens
  misc_feature (295)..(295): Any nucleotide
acatggcaggaaagaaaatcccagaagtgttattgaattcaggacacaaaatgccagtcataggaatgggaacatcagtagacaatcgtccatcaaatgatgttcttgcttcaatctttgttgatgcaattgaagttggttatcgtcatttcgattctgcttctgtttatggaacagaggaagctataggaattgctttagcaaaagctttagaaaaagggcttattaagagtagagatgaagttttcatcacttcaaagccatggaatactgatgcagattatgatcttattgntccagctctcaagaccacattgaaaaagctggggacaga

SEQ ID NO: 117 - DNA, 694 bp, Trifolium repens
  misc_feature (11)..(11): Any nucleotide
  misc_feature (23)..(23): Any nucleotide
  misc_feature (25)..(25): Any nucleotide
  misc_feature (32)..(33): Any nucleotides
  misc_feature (36)..(36): Any nucleotide
  misc_feature (43)..(43): Any nucleotide
  misc_feature (48)..(49): Any nucleotides
  misc_feature (62)..(62): Any nucleotide
  misc_feature (94)..(96): Any nucleotides
  misc_feature (101)..(101): Any nucleotide
  misc_feature (106)..(106): Any nucleotide
taagaatgaancaattttatctnanaaaaggnncangcaagtnagttnnattcaaacatagncttaaagtgtgtaacatattcttaacttaaannnttttnacccnacaaaaaaaaacaaagacaataacatgggtagtgttgaaattccaacaaaggttcttactaacacttctagtcaagtgaaaatgcctgtggttggaatgggatcagctcctgatttcacatgtaagaaagatacaaaagatgcaatcattgaagccatcaaacaaggttatagacactttgatactgctgctgcttatggctcagaacaagctcttggtgaaggtttgaaagaagcaattgaacttggccttgtcactagagaagagctttttgttacttctaaactttgggtcactgaaaatcatcctcaccttgttgttcctgctcttcaaaaatctctcaagactcttcaattggagtacttggacttgtatttgatccattggccacttagttctcagcctggaaagttttcatttccaattgatgtggcagatctcttgccatttgatgtgaagggtgtttgggaatccatggaagaaggcttgaaacttggactcactaaagctattggtgttagtaacttctctgtcaagaaacttcaaaatcttgtctcagttgccaccgttcttcctgcggtcaatcag

SEQ ID NO: 118 - protein, 188 aa, Trifolium repens
MGSVEIPTKVLTNTSSQVKMPVVGMGSAPDFTCKKDTKDAIIEAIKQGYRHFDTAAAYGSEQALGEGLKEAIELGLVTREELFVTSKLWVTENHPHLVVPALQKSLKTLQLEYLDLYLIHWPLSSQPGKFSFPIDVADLLPFDVKGVWESMEEGLKLGLTKAIGVSNFSVKKLQNLVSVATVLPAVNQ

SEQ ID NO: 119 - DNA, 576 bp, Trifolium repens
  misc_feature (11)..(11): Any nucleotide
  misc_feature (33)..(33): Any nucleotide
  misc_feature (36)..(36): Any nucleotide
  misc_feature (48)..(48): Any nucleotide
  misc_feature (62)..(62): Any nucleotide
  misc_feature (65)..(65): Any nucleotide
  misc_feature (95)..(95): Any nucleotide
taagaatgaancaattttatcttataaaaggtncangcaagttagttnctattaaacatagnctnaaagtgtgtaacatattcttaacttaaacnattttcacccaacaaaaaaaaacaaagacaataacatgggtagtgttgaaattccaacaaaggttcttactaacacttctagtcaagtgaaaatgcctgtggttggaatgggatcagctcctgatttcacatgtaagaaagatacaaaagatgcaatcattgaagccatcaaacaaggttatagacactttgatactgctgctgcttatggctcagaacaagctcttggtgaaggtttgaaagaagcaattgaacttggtcttgtcactagagaagagctttttgttgcttctaaactttgggtcactgaaaatcatcctcatcttgttgttcctgctcttcaaaaatctctcaagactcttcaattggagtacttggacttgtatttgattcactggccacttagttctcagcccggaaagttttcatttccaattgaggtggcagatctcttgccatttgatgtgaagggtgtttgggg

SEQ ID NO: 120 - DNA, 524 bp, Trifolium repens
  misc_feature (4)..(6): Any nucleotides
  misc_feature (13)..(14): Any nucleotides
  misc_feature (17)..(17): Any nucleotide
  misc_feature (24)..(24): Any nucleotide
  misc_feature (29)..(30): Any nucleotides
  misc_feature (33)..(33): Any nucleotide
  misc_feature (36)..(36): Any nucleotide
  misc_feature (43)..(43): Any nucleotide
  misc_feature (46)..(46): Any nucleotide
  misc_feature (55)..(55): Any nucleotide
  misc_feature (76)..(76): Any nucleotide
  misc_feature (524)..(524): Any nucleotide
tctnnnaaaaggnncangcaagtnagttnntanttnaactagnctnaaagtgtgnaacatattcttaacttaaacnattttcacccaacaaaaaaaaacaaagacaataacatgggtagtgttgaaattccaacaaaggttcttactaacacttctagtcaagtgaaaatgcctgtggttggaatgggatcagctcctgatttcacatgtaagaaagatacaaaagatgcaatcattgaagccatcaaacaaggttatagacactttgatactgctgctgcttatggctcagaacaagctcttggtgaaggtttgaaagaagcaattgaacttggtcttgtcactagagaagagctttttgttgcttctaaactttgggtcactgaaaatcatcctcatcttgttgttcctgctcttcaaaaatctctcaagactcttcaattggagtacttggacttgtatttgattcactggccacttagttctcagcccggaaagttttcatttccaattgaggtggcagn

SEQ ID NO: 121 - DNA, 577 bp, Trifolium repens
  misc_feature (2)..(2): Any nucleotide
  misc_feature (15)..(15): Any nucleotide
  misc_feature (18)..(18): Any nucleotide
  misc_feature (54)..(54): Any nucleotide
gnattcaaacatagnctnaaagtgtgtaacatattcttaacttaaaacattttnacccaacaaaaaaaaacaaagacaacaacatgggtagtgttgaaattccaacaaaggttcttactaacacttctagtcaagtgaaaatgcctgtggttggaatgggatcagctcctgatttcacatgtaagaaagatacaaaagatgcaatcattgaagccatcaaacaaggttatagacactttgatattgctgctgcttatggctcagaacaagctcttggtgaaggtttgaaagaagcaattgaacttggtcttgtcactagagaagacctttttgttacttctaaactttgggtcactgaaaatcatcctcaccttgttattcctgctcttcaaaaatctctcaagactcttcaattggagtacttggacttgtatttgatccactggccacttagttctcagcccggaaagttttcatttccaattgaggtggcagatctcttgccatttgatgtgaggggtgtttggcaatccatggaagaaggcttgaaacttggactcactaaagctattggtgt

SEQ ID NO: 122 - DNA, 597 bp, Trifolium repens
  misc_feature (13)..(13): Any nucleotide
  misc_feature (16)..(16): Any nucleotide
  misc_feature (29)..(29): Any nucleotide
  misc_feature (47)..(47): Any nucleotide
  misc_feature (52)..(52): Any nucleotide
  misc_feature (57)..(57): Any nucleotide
  misc_feature (597)..(597): Any nucleotide
attcaaacatagnctnaaagtgtgtaacntattcttaacttaaaacnttttnacccnacaaaaaaaaacaaagacaacaacatgggtagtgttgaaattccaacaaaggttcttactaacacttctagtcaagtgaaaatgcctgtggttggaatgggatcagctcctgatttcacatgtaagaaagatacaaaagatgcaatcattgaagccatcaaacaaggttatagacactttgatattgctgctgcttatggctcagaacaagctcttggtgaaggtttgaaagaagcaattgaacttggtcttgtcactagagaagacctttttgttacttctaaactttgggtcactgaaaatcatcctcaccttgttattcctgctcttcaaaaatctctcaagactcttcaattggagtacttggacttgtatttgatccactggccacttagttctcagcccggaaagttttcatttccaattgaggtggcagatctcttgccatttgatgtgaggggtgtttggcaatccatggaagaaggcttgaaacttggactcactaaagctattggtgtcagtaacttctctgtcaagaan

SEQ ID NO: 123 - DNA, 293 bp, Trifolium repens
  misc_feature (17)..(17): Any nucleotide
  misc_feature (51)..(51): Any nucleotide
  misc_feature (59)..(59): Any nucleotide
  misc_feature (224)..(224): Any nucleotide
  misc_feature (250)..(250): Any nucleotide
  misc_feature (257)..(257): Any nucleotide
  misc_feature (274)..(277): Any nucleotides
  misc_feature (279)..(280): Any nucleotides
  misc_feature (285)..(285): Any nucleotide
  misc_feature (293)..(293): Any nucleotide
ttcaaacatagcctccnagtgtgtaacatattcttaacttaaaacattttnacccaacnataaaaaacaaagacaacaacatgggtagtgttgaaattccaacaaaggttcttactaacagttctagtcaagtgaaaatgcctgtggttggaatgggatcagctcctgacttcacatgtaagaaagacacaaaagatgcaatcattgaagccatcaaacaaggntatagacactttgaaactgctgctgnttatgcntcacaacaagctcttgnnnnanncttcnatgccccn

SEQ ID NO: 124 - DNA, 636 bp, Trifolium repens
  misc_feature (4)..(4): Any nucleotide
  misc_feature (12)..(12): Any nucleotide
  misc_feature (86)..(86): Any nucleotide
  misc_feature (244)..(244): Any nucleotide
  misc_feature (261)..(261): Any nucleotide
  misc_feature (458)..(458): Any nucleotide
  misc_feature (485)..(485): Any nucleotide
  misc_feature (507)..(507): Any nucleotide
  misc_feature (515)..(515): Any nucleotide
  misc_feature (540)..(540): Any nucleotide
  misc_feature (545)..(545): Any nucleotide
  misc_feature (574)..(574): Any nucleotide
  misc_feature (577)..(578): Any nucleotides
  misc_feature (588)..(588): Any nucleotide
  misc_feature (593)..(593): Any nucleotide
  misc_feature (609)..(609): Any nucleotide
  misc_feature (630)..(630): Any nucleotide
ttcnaacatagnctcaaagtgtgtaacatattcttaacttaaaacattttcacccaacaaaaaaaaacaaagacaacaacatgggnagggttgaaattccaacaaaggttcttactaacacttctagtcaagtgaaaatgcctgtggttggaatgggatcagctcctgattttacatgtaaaaaagacacaaaagatgcaatcattgaagccatcaaacaaggttatagacactttgatactgntgctgcttatggctcanaacaagctcttggtgaaggtttgaaagaagcaattgaacttggccttgtcactagaaaagagctttttgttacttctaaactttgggtcactgaaaatcatcctcaccttgttgttcctgctcttcaaaaatctctcaagactcttcaattggagtacttggacttgtatttgatccattggccacttaattctcancctggaaagttttcatttcccattgangtggcaaatctcttgccatttnatgtgaanggtgtttgggaatccatggaaaaangcttnaaacttggactcactaaagctattggtgncannaacttctctntcaanaaacttcaaaatcttntctcaattgccaccgttcttnctgcgg

SEQ ID NO: 125 - DNA, 570 bp, Trifolium repens
  misc_feature (8)..(8): Any nucleotide
  misc_feature (11)..(11): Any nucleotide
  misc_feature (21)..(21): Any nucleotide
  misc_feature (23)..(23): Any nucleotide
  misc_feature (25)..(25): Any nucleotide
  misc_feature (41)..(42): Any nucleotides
  misc_feature (55)..(55): Any nucleotide
aacatagnctnaaagtgtgtnananattcttaacttaaaannttttcacccaacnaaaaaaaacaaagacaaaaacatgggtagtgttgaaattccaacaaaggttcttactaacacttctagtcaagtgaaaatgcctgtggttggaatgggatcagcacctgatttcacatgtaagaaagacacaaaagatgcaatcattgaagccatcaaacaaggttatagacactttgatactgctgctgcttatggctcagaacaagctcttggtggaggtttgaaagaagcaattgaacttggccttgtcactagagaagagctttttgttacttctaaactttgggtcactgaaaatcatcctcaccttgttgttcctgctcttcaaaaatctctcaagactcttcaattggagtacttggacttgtatttgatccattggccacttagttctcagcctggaaagttttcatttccaattgatgtggcagatctcttgccatttgatgtgaagggtgtttggcaatccatggaagaaggcttgaaacttggactcactaaagctattggtgt

SEQ ID NO: 126 - DNA, 621 bp, Trifolium repens
  misc_feature (5)..(5): Any nucleotide
  misc_feature (9)..(9): Any nucleotide
  misc_feature (17)..(18): Any nucleotides
  misc_feature (21)..(22): Any nucleotides
  misc_feature (27)..(27): Any nucleotide
  misc_feature (32)..(32): Any nucleotide
  misc_feature (38)..(38): Any nucleotide
  misc_feature (44)..(44): Any nucleotide
  misc_feature (49)..(51): Any nucleotides
  misc_feature (62)..(62): Any nucleotide
acatngctnaagtgtgnnaannattcntaacntaaacnattttnacccnnnacaaaaaaacnaagacaataacatgggtagtgttgaaattccaacaaaggttcttactaacacttctagtcaagtgaaaatgcctgtggttggaatgggatcagctcctgatttcacatgtaagaaagatacaaaagatgcaatcattgaagccatcaaacaaggttatagacactttgatactgctgctgcttatggctcagaacaagctcttggtgaaggtttgaaagaagcaattgaacttggccttgtcactagagaagagctttttgttacttctaaactttgggtcactgaaaatcatcctcatcttgttgttcctgctcttcaaaaatctctcaagactcttcaattggagtacttggacttgtatttgatccattggccacttagttctcagcctggaaagttttcatttccaattgatgtggcagatctcttgccatttgatgtgaagggtgtttgggaatccatggaagaaggcttgaaacttggactcactaaagctattggtgttagtaacttctctgtcaagaaacttcaaaatcttgtctcagttgccaccgttct

SEQ ID NO: 127 - DNA, 573 bp, Trifolium repens
  misc_feature (8)..(8): Any nucleotide
  misc_feature (16)..(16): Any nucleotide
  misc_feature (19)..(19): Any nucleotide
  misc_feature (36)..(38): Any nucleotides
  misc_feature (43)..(43): Any nucleotide
  misc_feature (48)..(48): Any nucleotide
  misc_feature (61)..(61): Any nucleotide
  misc_feature (573)..(573): Any nucleotide
catagctnaagtgtgnaanaatttcttaactaaaannnttttnacccnacaaaaaaaaacnaagacaaaaacatgggtagtgttgaaattccaacaaaggttcttactaacagttctagtcaagtgaaaatgcctgtggttggaatgggatcagcacctgatttcacatgtaagaaagacacaaaagatgcaatcattgaagccatcaaacaaggttatagacactttgatactgctgctgcttatggctcagaacaagctcttggtgaaggtttgaaagaagcaattgaacttggccttgtcactagagaagagctttttgttacttctaaactttgggtcactgaaaatcatcctcaccttgttgttcctgctcttcaaaaatctctcaagactcttcaattggagtacttggacttgtatttgatccattggccacttagttctcagcctggaaagttttcatttccaattgatgtggcagatctcttgccatttgatgtgaagggtgtttgggaatccatggaagaaggcttgaaacttggactcactaaagctattggtgttagtaan

SEQ ID NO: 128 - DNA, 583 bp, Trifolium repens
  misc_feature (4)..(4): Any nucleotide
  misc_feature (16)..(17): Any nucleotides
  misc_feature (19)..(20): Any nucleotides
  misc_feature (26)..(26): Any nucleotide
  misc_feature (31)..(31): Any nucleotide
  misc_feature (36)..(38): Any nucleotides
  misc_feature (43)..(43): Any nucleotide
  misc_feature (48)..(48): Any nucleotide
  misc_feature (61)..(61): Any nucleotide
  misc_feature (79)..(79): Any nucleotide
  misc_feature (81)..(81): Any nucleotide
  misc_feature (83)..(84): Any nucleotides
  misc_feature (239)..(239): Any nucleotides
catngctaaagtgtgnnanntattcntaacntaaannnttttnacccnacaaaaaaaaacnaagacaataacatgggtngngnngaaattccaacaaaggttcttactaacacttctagtcaagtgaaaatgcctgtggttggaatgggatcagctcctgatttcacatgtaagaaagatacaaaagatgcaatcattgaagccatcaaacaaggttatagacactttgatactgctgntgcttatggctcagaacaagctcttggtgaaggtttgaaagaagcaattgaacttggccttgtcactagagaagagctttttgttacttctaaactttgggtcactgaaaatcatcctcaccttgttattcctgctcttcaaaaatctctcaagactcttcaattggagtacttggacttgtatttgatccattggccacttagttctcagcctggaaagttttcatttccaattgatgtggcagatctcttgccatttgatgtgaagggtgtttgggaatccatggaagaaggcttgaaacttggactcactaaagctattggtgttagtaacttctctgtcc

SEQ ID NO: 129 - DNA, 597 bp, Trifolium repens
  misc_feature (4)..(4): Any nucleotide
  misc_feature (8)..(8): Any nucleotide
  misc_feature (16)..(16): Any nucleotide
  misc_feature (18)..(18): Any nucleotide
  misc_feature (21)..(21): Any nucleotide
  misc_feature (36)..(38): Any nucleotides
  misc_feature (48)..(48): Any nucleotides
  misc_feature (61)..(61): Any nucleotides
  misc_feature (67)..(67): Any nucleotides
catngctnaagtgtgnancanatttctaactaaaannnttttcacccnacaaaaaaaaacnaagacnaaaacatgggtagtgttgaaattccaacaaaggttcttactaacagttctagtcaagtgaaaatgcctgtggttggaatgggatcagcacctgatttcacatgtaagaaagacacaaaagatgcaatcattgaagccatcaaacagggttatagacactttgatactgctgctgcttatggctcagaacaagctcttggtgaaggtttgaaagaagcaattgaacttggtcttgtcactagagaagacctttttgttacttctaaactttgggtcactgaaaatcatcctcatcttgttgttcctgctcttcaaaaatctctcaagactcttcaattggagtacttggacttgtatttgatccattggccacttagttctcagcctggaaagttttcatttccaattgatgtggcagatctcttgccatttgatgtgaagggtgtttgggaatccatggaagaaggcttgaaacttggactcactaaagctattggtgttagtaacttctctgtcaagaaacttcaaaat

SEQ ID NO: 130 - DNA, 597 bp, Trifolium repens
  misc_feature (16)..(17): Any nucleotides
  misc_feature (19)..(19): Any nucleotide
  misc_feature (28)..(28): Any nucleotide
  misc_feature (36)..(38): Any nucleotides
  misc_feature (48)..(48): Any nucleotide
  misc_feature (55)..(55): Any nucleotide
  misc_feature (61)..(61): Any nucleotide
catagctaaagtgtgnnanaatttcttnactaaaannnttttcacccnacaaaanaaaacnaagacaaaaacatgggtagtgttgaaattccaacaaaggttcttactaacacttctagtcaagtgaaaatgcctgtggttggaatgggatcagcacctgatttcacatgtaagaaagacacaaaagatgcaatcattgaagccatcaaacaaggttatagacactttgatactgctgctgcttatggctcagaacaagctcttggtggaggtttgaaagaagcaattgaacttggccttgtcactagagaagagctttttgttacttctaaactttgggtcactgaaaatcatcctcaccttgttgttcctgctcttcaaaaatctctcaagactcttcaattggagtacttggacttgtatttgatccattggccacttagttctcagcctggaaagttttcatttccaattgatgtggcagatctcttgccatttgatgtgaagggtgtttggcaatccatggaagaaggcttgaaacttggactcactaaagctattggtgttagtaacttctctgtcaagaaacttcaaaat

SEQ ID NO: 131 - DNA, 574 bp, Trifolium repens
  misc_feature (2)..(2): Any nucleotide
  misc_feature (26)..(28): Any nucleotides
  misc_feature (33)..(33): Any nucleotide
  misc_feature (38)..(38): Any nucleotide
  misc_feature (51)..(51): Any nucleotide
  misc_feature (57)..(57): Any nucleotide
  misc_feature (83)..(83): Any nucleotide
  misc_feature (519)..(519): Any nucleotide
  misc_feature (540)..(540): Any nucleotide
  misc_feature (559)..(561): Any nucleotides
  misc_feature (568)..(568): Any nucleotide
  misc_feature (572)..(572): Any nucleotide
  misc_feature (574)..(574): Any nucleotide
gngtgtaacatattcttaacttaaannnttttnacccnacaaaaaaaaacnaagacnataacatgggtagtgttgaaattccnacaaaggttcttactaacacttctagtcaagtgaaaatgcctgtggttggaatgggatcagctcctgatttcacatgtaagaaagatacaaaagatgcaatcattgaagccatcaaacaaggttatagacactttgatactgctgctgcttatggctcagaacaagctcttggtgaaggtttgaaagaagcaattgaacttggccttgtcactagagaagagctttttgttacttctaaactttgggtcactgaaaatcatcctcaccttgttgttcctgctcttcaaaaatctctcaagactcttcaattggagtacttggacttgtatttgatccattggccacttagttctcagcctggaaagttttcatttccaattgatgtggcagatctcttgccatttgatgtgaagggtgtttgggaatccatggaanaaggcttgaaacttggactcnctaaagctattggtgttannnacttctntgtnan

SEQ ID NO: 132 - DNA, 578 bp, Trifolium repens
  misc_feature (2)..(2): Any nucleotide
  misc_feature (14)..(14): Any nucleotide
  misc_feature (26)..(27): Any nucleotides
  misc_feature (33)..(33): Any nucleotide
  misc_feature (37)..(37): Any nucleotide
  misc_feature (578)..(578): Any nucleotide
gngtgtaacatatncttaacttaaannattttnaccnaacaaaaaaaaacaaagacaataacatgggtagtgttgaaattccaacaaaggttcttactaacacttctagtcaagtgaaaatgcctgtggttggaatgggatcagctcctgatttcacatgtaagaaagatacaaaagatgcaatcattgaagccatcaaacaaggttatagacactttgatactgctgctgcttatggctcagaacaagctcttggtgaaggtttgaaagaagcaattgaacttggccttgtcactagagaagagctttttgttacttctaaactttgggtcactgaaaatcatcctcaccttgttgttcctgctcttcaaaaatctctcaagactcttcaattggagtacttggacttgtatttgatccattggccacttagttctcagcctggaaagttttcatttccaattgatgtggcagatctcttgccatttgatgtgaagggtgtttgggaatccatggaagaaggcttgaaacttggactcactaaagctattggtgttagtaacttctctgtcaagaan

SEQ ID NO: 133 - DNA, 600 bp, Trifolium repens
  misc_feature (6)..(6): Any nucleotide
  misc_feature (8)..(12): Any nucleotides
  misc_feature (26)..(28): Any nucleotides
  misc_feature (33)..(33): Any nucleotide
  misc_feature (37)..(38): Any nucleotides
  misc_feature (48)..(48): Any nucleotide
  misc_feature (51)..(51): Any nucleotide
  misc_feature (57)..(59): Any nucleotides
gtgtgnannnnntttctaactaaaannnttttnaccnnacaaaaaatnaangacacnnnaacatgggtagtgttgaaattccaacaaaggttcttactaacagttctagtcaagtgaaaatgcctgtggttggaatgggatcagcacctgatttcacatgtaagaaagacacaaaagatgcaatcattgaagccatcaaacaaggttatagacactttgatactgctgctgcttatggctcagaacaagctcttggtgaaggtttgaaagaagcaattgaacttggccttgtcactagagaagagctttttgttacttctaaactttgggtcactgaaaatcatcctcaccttgttgttcctgctcttcaaaaatctctcaagactcttcaattggagtacttggacttgtatttgatccattggccacttagttctcagcccgaaaagttttcatttccaattgatgtggcagatctcttgccatttgatgtgaagggtgtttgggaatccatggaagaaggcttgaaacttggactcactaaagctattggtgtcagtaacttctctgtcaagaaacttcaaaatcttgtctcagttg

SEQ ID NO: 134 - DNA, 612 bp, Trifolium repens
  misc_feature (1)..(1): Any nucleotide
  misc_feature (6)..(6): Any nucleotide
  misc_feature (13)..(14): Any nucleotides
  misc_feature (19)..(19): Any nucleotide
  misc_feature (23)..(24): Any nucleotides
  misc_feature (27)..(27): Any nucleotide
  misc_feature (37)..(37): Any nucleotide
  misc_feature (43)..(43): Any nucleotide
  misc_feature (46)..(46): Any nucleotide
  misc_feature (69)..(69): Any nucleotide
nttctnactaaannttttnaccnnacnaaaaaaaacnaagacnatnacatgggtagtgttgaaattccnacaaaggttcttactaacacttctagtcaagtgaaaatgcctgtggttggaatgggatcagctcctgatttcacatgtaagaaagatacaaaagatgcaatcattgaagccatcaaacaaggttatagacactttgatactgctgctgcttatggctcagaacaagctcttggtgaaggtttgaaagaagcaattgaacttggccttgtcactagagaagagctttttgttacttctaaactttgggtcactgaaaatcatcctcaccttgttgttcctgctcttcaaaaatctctcaagactcttcaattggagtacttggacttgtatttgatccattggccacttagttctcagcctggaaagttttcatttccaattgatgtggcagatctcttgccatttgatgtgaagggtgtttgggaatccatggaagaaggcttgaaacttggactcactaaagctattggtgttagtaacttctctgtcaagaaacttcaaaatcttgtctcagttgccaccgttcttcctgcggtcaatcag

SEQ ID NO: 135 - DNA, 610 bp, Trifolium repens
  misc_feature (7)..(7): Any nucleotide
  misc_feature (30)..(30): Any nucleotide
  misc_feature (41)..(41): Any nucleotide
  misc_feature (67)..(67): Any nucleotide
gcacacnttcttgacttaccaattgtaatncataataattntaaacatgtcaaagacagtttgtgtnaccggagccagcggagccatcggttcatgggtggttcgcctcctcctcgaacgcggctacattgtccacgccaccatccaagatctcgaggatgagaacgagacaaaacatttggaagcaatggaaggagcaaagggtcatctcaaatttttcgaaatggatcttcttaacagcgactctattgcggccgccgtgaaaggttgtgccggagttatacatcttgcatgtcctaacatcattggtgaagtcaaagaccccgagaagcaaattttggaaccggcaattcaaggaacggttaatgtgttgaaggtggcaaaggaagcaggggtggagcgtgtggtggcgacatcgtcgatctccgccatcataccgagtcctaattggccagctgataagattaagggagaagattgttggacagaccttgattattgcaaggaaaagaagttatactaccccattgcaaagacactagcagaaaaagctggttgggaatttgctaaagagaccggttttgatgttgttatgattaaccctggtact

SEQ ID NO: 136 - protein, 188 aa, Trifolium repens
  MISC_FEATURE (7)..(7): Any amino acid
MSKTVCXTGASGAIGSWVVRLLLERGYIVHATIQDLEDENETKHLEAMEGAKGHLKFFEMDLLNSDSIAAAVKGCAGVIHLACPNIIGEVKDPEKQILEPAIQGTVNVLKVAKEAGVERVVATSSISAIIPSPNWPADKIKGEDCWTDLDYCKEKKLYYPIAKTLAEKAGWEFAKETGFDVVMINPGT

SEQ ID NO: 137 - DNA, 327 bp, Trifolium repens
  misc_feature (30)..(30): Any nucleotide
  misc_feature (41)..(41): Any nucleotide
  misc_feature (67)..(67): Any nucleotide
  misc_feature (255)..(255): Any nucleotide
  misc_feature (271)..(271): Any nucleotide
  misc_feature (287)..(287): Any nucleotide
  misc_feature (291)..(291): Any nucleotide
  misc_feature (313)..(313): Any nucleotide
  misc_feature (317)..(319): Any nucleotides
  misc_feature (326)..(327): Any nucleotides
gcacaccttcttgacttaccaattgtaatncataataattntaaacatgtcaaagacagtttgtgtnaccggagccagcggagccatcggttcatgggtggttcgcctcctcctcgaacgcggctacattgtccacgccaccatccaagatctcgaggatgagaacgagacaaaacatttggaagcaatggaaggagcaaagggtcatctcaaatttttcgaaatggatcttcttaacagcgactctattgcggncgccgtgaaaggttgngccggagttatacatnttgnctgtcctaccccccttggggangagnnngcacccnn

SEQ ID NO: 138 - DNA, 349 bp, Trifolium repens
  misc_feature (3)..(3): Any nucleotide
  misc_feature (7)..(7): Any nucleotide
  misc_feature (30)..(30): Any nucleotide
  misc_feature (67)..(67): Any nucleotide
  misc_feature (287)..(287): Any nucleotide
  misc_feature (314)..(314): Any nucleotide
  misc_feature (316)..(316): Any nucleotide
  misc_feature (320)..(320): Any nucleotide
  misc_feature (324)..(324): Any nucleotide
  misc_feature (328)..(328): Any nucleotide
  misc_feature (333)..(333): Any nucleotide
  misc_feature (341)..(341): Any nucleotide
  misc_feature (346)..(346): Any nucleotide
  misc_feature (348)..(349): Any nucleotides
gcncacnttcttgacttaccaattgtaatncataatatttataaacatgtcaaagacagtttgtgtnaccggagccagcggagccatcggttcatgggtggttcgcctcctcctggaacgcggctacatcgtccacgccaccatccaagatctcgaggatgagaacgagacaaaacatttggaagcaatggaaggggcaaagggtcatcttaaatttttcgaaatggatcttcttaacagtgactctattgcggccgccgtgaaaggttgtgccggagttatacatnttgcatgtgctaacatcattgctgaangnaaanaccncganaacgngattttgnaaccngnn

SEQ ID NO: 139 - DNA, 592 bp, Trifolium repens
  misc_feature (7)..(7): Any nucleotide
  misc_feature (20)..(20): Any nucleotide
  misc_feature (30)..(30): Any nucleotide
  misc_feature (41)..(41): Any nucleotide
  misc_feature (481)..(481): Any nucleotide
  misc_feature (505)..(505): Any nucleotide
  misc_feature (542)..(542): Any nucleotide
gcacacnttcttgacttacnaattgtaatncataataattntaaacatgtcaaaggcagtttgtgtcaccggagccagcggagccattggttcatgggtggttcgcctcctcctccaacgcggctacattgtccacgccaccatccaagatctcgaggatgagaacgagacaaaacatttggaagcaatggaaggagcaaagggtcatctcaaattttttgaaatggatcttcttaacagcgactctattgcggccgccgtgaaaggttgtgccggagttatacatcttgcatgtcctaacatcattggtgaagtcaaagaccccgagaagcaaattttggaaccggcaattcaaggaacggttaatgtgttgaaggtggcaaaggaagcaggggtggagcgtgtggtggcgacatcgtcgatctccgccatcataccgagtcctaattggccagctgataagattaagggagaagattgntggacagaccttgattattgcaangaaaagaagttatactaccccattgcaaagacattancagaaaaagctggttgggaatttgctaaagagaccggttttgatgttgtt

SEQ ID NO: 140 - DNA, 594 bp, Trifolium repens
  misc_feature (7)..(7): Any nucleotide
  misc_feature (30)..(30): Any nucleotide
  misc_feature (41)..(41): Any nucleotide
gcacacnttcttgacttaccaattgtaatncataataattntaaacatgtcaaagacagtttgtgtcaccggagccagcggagccatcggttcatgggtggttcgcctcctcctcgaacgcggctacattgtccacgccaccatccaagatctcgaggatgagaacgagacaaaacatttggaagcaatggaaggagcaaagggtcatctcaaatttttcgaaatggatcttctcaacagcgactctattgcggccgccgtgaaaggttgtgccggagttatacatcttgcatgtcctagcatcattggtgaagtcaaagaccccgagaagcaaattttggaaccggcaattcaaggaacggttaatgtgttgaaggtggcaaaggaagcaggggtggagcgtgtggtggcgacatcgtcgatctccgccatcataccgagtcctaattggccagctgataagattaagggagaagattgttggacagaccttgattattgcaaggaaaagaagttatactaccccattgcaaagacactagcagaaaaagctggttgggaatttgctaaagagaccggttttgatgttgttat

SEQ ID NO: 141 - DNA, 583 bp, Trifolium repens
  misc_feature (4)..(4): Any nucleotide
  misc_feature (14)..(14): Any nucleotide
  misc_feature (18)..(18): Any nucleotide
  misc_feature (28)..(28): Any nucleotide
  misc_feature (49)..(50): Any nucleotides
gccncttcttgacncacnaattgtaatncataataattataaacatgtnnaagacagtttgtgtcactggagccagcggagccatcggttcatgggtggttcgcctcctcctccaacgcggctacattgtccacgccaccatccaagatctcgaggatgagaacgagacaaaacatttggaagcaatggaaggagcaaagggtcatctcaaatttttcgaaatggatcttcttaacagcgactctattgcggccgccgtgaaaggttgtgccggagttatacatcttgcatgtcctaacatcattggtgaagtcaaagaccccgagaagcaaattttggaaccggcaattcaaggaacggttaatgtgttgaaggtggcaaaggaagcaggggtggagcgtgtggtggcgacatcgtcgatctctgccatcataccgagtcctaattggccagctgataagattaagggagaagattgttggacagaccttgattattgcaaggaaaagaagttatactaccccattgcaaagacactagcagaaaaagctggttgggaatttgctagagagaccggttttgt

SEQ ID NO: 142 - DNA, 608 bp, Trifolium repens
  misc_feature (4)..(4): Any nucleotide
  misc_feature (18)..(18): Any nucleotide
  misc_feature (28)..(28): Any nucleotide
  misc_feature (39)..(39): Any nucleotide
  misc_feature (49)..(49): Any nucleotide
  misc_feature (65)..(65): Any nucleotide
gctncttcttgacttacnaattgtaatncataataattntaaacatgtnaaagacagtttgtgtnaccggagccagcggagccatcggttcatgggtggttcgcctcctcctcgaacgcggctacattgtccacgccaccatccaagatctcgaggatgagaacgagacaaaacatttggaagcaatggaaggagcaaagggtcatctcaaatttttcgaaatggatcttctcaacagcgactctattgcggccgccgtgaaaggttgtgccggagttatacatcttgcatgtcctagcatcattggtgaagtcaaagaccccgagaagcaaattttggaaccggcaattcaaggaacggttaatgtgttgaaggtggcaaaggaagcaggggtggagcgtgtggtggcgacatcgtcgatctccgccatcataccgagtcctaattggccagctgataagattaagggagaagattgttggacagaccttgattattgcaaggaaaagaagttatactaccccattgcaaagacactagcagaaaaagctggttgggaatttgctaaagagaccggttttgatgttgttatgattaaccctggtact

SEQ ID NO: 143 - DNA, 571 bp, Trifolium repens
  misc_feature (2)..(2): Any nucleotide
  misc_feature (11)..(11): Any nucleotide
  misc_feature (25)..(25): Any nucleotide
  misc_feature (36)..(36): Any nucleotide
  misc_feature (47)..(47): Any nucleotide
  misc_feature (62)..(63): Any nucleotides
  misc_feature (72)..(72): Any nucleotide
  misc_feature (537)..(537): Any nucleotide
cnttcttgacntaccaattgtaatncataataattntaaacatgtcnaaggcagtttgtgtnnccggagccngcggagccattggttcatgggtggttcgcctcctcctccaacgcggctacattgtccacgccaccatccaagatctcgaggatgagaacgagacaaaacatttggaagcaatggaaggagcaaagggtcatctcaaattttttgaaatggatcttcttaacagcgactctattgcggccgccgtgaaaggttgtgccggagttatacatcttgcatgtcctaacatcattggtgaagtcaaagaccccgagaagcaaattttggaaccggcaattcaaggaacggttaatgtgttgaaggtggcaaaggaagcaggggtggagcgtgtggtggcgacatcgtcgatctccgccatcataccgagtcctaattggccagctgataagattaagggagaagattgttggacagaccttgattattgcaaggaaaagaagttatactaccccattgcaaagacattancagaaaaagctggttgggaatttgctaaagagac

SEQ ID NO: 144 - DNA, 586 bp, Trifolium repens
  misc_feature (2)..(2): Any nucleotide
  misc_feature (15)..(15): Any nucleotide
  misc_feature (25)..(25): Any nucleotide
cnttcttgacttacnaattgtaatncataatatttataaacatgtcaaagacagtttgtgtcaccggagccagcggagccatcggttcatgggtggttcgtctcctcctggaacgcggctacatcgtccacgccaccatccaagatctcgaggatgagaacgagacaaaacatttggaagcaatggaaggggcaaagggttatcttaaatttttcgaaatggatcttcttaacagtgactctattgcggccgccgtgaaaggttgtgccggagttatacatcttgcatgtcctaacatcattggtgaagtcaaagaccccgagaagcaaattttggaaccggcgattcaaggaacggttaacgtgttgaaggtggcaaaggaagcaggggtggagcgtgtggtggcgacgtcatcgatctccgccatcataccgagtcctaattggccagctgataagattaagggagaagattgttggacggaccttgattattgcaaggaaaagaagttacactaccccatcgcaaagacactagcagaaaaagctggttgggaatttgctaaagagaccggttttgatgttgt

SEQ ID NO: 145 - DNA, 328 bp, Trifolium repens
  misc_feature (10)..(10): Any nucleotide
  misc_feature (19)..(19): Any nucleotide
  misc_feature (24)..(24): Any nucleotide
  misc_feature (31)..(31): Any nucleotide
  misc_feature (35)..(37): Any nucleotides
  misc_feature (41)..(41): Any nucleotide
  misc_feature (45)..(45): Any nucleotide
  misc_feature (61)..(61): Any nucleotide
  misc_feature (71)..(71): Any nucleotide
  misc_feature (249)..(249): Any nucleotide
  misc_feature (289)..(289): Any nucleotide
  misc_feature (310)..(310): Any nucleotide
  misc_feature (315)..(315): Any nucleotide
  misc_feature (320)..(320): Any nucleotide
  misc_feature (326)..(326): Any nucleotide
  misc_feature (328)..(328): Any nucleotide
tttcttgacntacccattnttatncataatnattnnnaacntgtnaaagacagtttgtgtnaccggagccngcggagccatcggttcatgggtggttcgcctcctcctcgaacgcggctacattgtccacgccaccatccaagatctcgaggatgagaacgagacaaaacatttggaagcaatggaaggagcaaagggtcatctcaaattttttgaaatggatcttcttaacagcgactctattgcggncgccgtgaaaggttgtgccggagttatacatcttgcatgngctaacatcattggggaagcnaaagnactcnataagnan

SEQ ID NO: 146 - DNA, 232 bp, Trifolium repens
  misc_feature (1)..(1): Any nucleotide
  misc_feature (3)..(3): Any nucleotide
  misc_feature (12)..(12): Any nucleotide
  misc_feature (14)..(14): Any nucleotide
  misc_feature (21)..(22): Any nucleotides
  misc_feature (39)..(39): Any nucleotide
  misc_feature (60)..(60): Any nucleotide
  misc_feature (69)..(69): Any nucleotide
  misc_feature (154)..(154): Any nucleotide
  misc_feature (156)..(156): Any nucleotide
  misc_feature (178)..(178): Any nucleotide
  misc_feature (186)..(186): Any nucleotide
  misc_feature (232)..(232): Any nucleotide
ngngtttgtgtnanctgagcnngcggagccctcggttantgggtggttcgcctcctcctnccacgcggntacattgtccacgccaccatccaagatctcgaggatgagaacgagacaaaacatttggaagcaatggaaggagcaaagggtcatntnaaatttttcgaaatggatcttnttaacagngactctattgcggccgccgtgaaaggttgtgccggagttatacatn

SEQ ID NO: 147 - DNA, 623 bp, Trifolium repens
  misc_feature (11)..(11): Any nucleotide
  misc_feature (14)..(14): Any nucleotide
ataaaaccaanctncaaaactgattggaactcagaaaaatagaagaaaagagatgcctgagttttgtgttacagggggcactggcttcatagcagcctacctagtgaaagccttattagaaaagggtcacacagtaaggactactgtaagaaacccagatgatttggagaaggttggttatctaactgaactaagtgaagacaaagagagattgaagattttaaaagcagatctattggtggaagggagttttgatgaggcagtgagtggtgttgatggtgtgtttcatacagcttcccctgttcttgttccacatgatgacaacattcaggttactttgattgatccatgtataaaaggaacacaaaatgtgcttaactcatgcatcaaagcaaaggtgaaacgtgtggtgttaacatcttcatgctcttccataagataccgtgacgatgtgcaacaaatttctcctcttaatgaatctcattggagtgattctgaatactgcaaacgctataacctgtggtatgcatatgcaaagactttaggagaaaaagaagcatggaggattgcaaaggaaagtggaattgatctagttgtagttaacccctcttttgttggtggtc

SEQ ID NO: 148 - protein, 190 aa, Trifolium repens
MPEFCVTGGTGFIAAYLVKALLEKGHTVRTTVRNPDDLEKVGYLTELSEDKERLKILKADLLVEGSFDEAVSGVDGVFHTASPVLVPHDDNIQVTLIDPCIKGTQNVLNSCIKAKVKRVVLTSSCSSIRYRDDVQQISPLNESHWSDSEYCKRYNLWYAYAKTLGEKEAWRIAKESGIDLVVVNPSFVGG

SEQ ID NO: 149 - DNA, 570 bp, Trifolium repens
  misc_feature (11)..(11): Any nucleotide
  misc_feature (14)..(14): Any nucleotide
  misc_feature (32)..(32): Any nucleotide
ataaaaccaanctncaaaactgattggaactnagaaaaatagaagaaaagagatgcctgagttttgtgttacagggggcactgggttcatagcagcctacctagtgaaagccttattagaaaagggtcacacagtaaggactactgtaagaaacccagatgatttggagaaggttggttatctaactgaactaagtgaagacaaagagagattgaagattttaaaagcagatctattggtggaagggagttttgatgaggcagtgagtggtgttgatggtgtgtttcatacagcttcccctgttcttgttccacatgatgacaatattcaggttactttgattgatccatgtataaaaggaacacaaaatgtgcttagctcatgcatcaaagcaaaggtgaaacgtgtggtgttaacatcttcatgctcttccataagataccgtgacgatgtgcaacaaatttcaccacttaatgaatctcattggagtgattctgaatactgcaaacgctataacctgtggtatgcatatgcaaagacattaggagaaaaagaagcatggaggattgc

SEQ ID NO: 150 - DNA, 572 bp, Trifolium repens
  misc_feature (2)..(2): Any nucleotide
  misc_feature (8)..(9): Any nucleotides
gnacctcnnaaaaatagaagaaaagagatgcctgagttttgtgttacagggggcactgggttcatagcagcctacctagtgaaagccctattagaaaagggtcacacagtaaggactactgtaagaaacccagatgatttggagaaggttggttatctaactgaactaagtgaagacaaagagagattgaagattttaaaagcagatctattggtggaagggagttttgatgaggcagtgagtggtgttgatggtgtgtttcatacagcttcccctgttcttgttccacatgatgacaatattcaggttactttgattgatccatgtataaaaggaacacagaatgtgcttaactcatgcatcaaagcaaaggtgaaacgtgtggtgttaacatcctcatgctcttccataagataccgtgacgatgtgcaacaaatttctcctcttaatgaatctcattggagtgattctgattactgcaaacgctataacctgtggtatgcatatgcaaagactttaggagaaaaagaagcatggaggattgcaaaggaaagtgggattaatctagttgt

SEQ ID NO: 151 - DNA, 572 bp, Trifolium repens
ggaaagagatgcctgagttttgtgttacagggggcactggcttcatagcagcttacctagtgaaagccttattagaaaagggtcacacagtaaggactactgtaagaaacccagatgatttggagaaggttggttatctaactgaacttagtgaagacaaagagagattgaagattttaaaagcagatctattggtggaagggagttttgatgaggcagtgagtggtgttgatggtgtgtttcatacagcttcccctgttcttgttccacatgatgacaacattcaggttactttgattgatccatgtataaaaggaacacaaaatgtgcttaactcatgcatcaaagcaaaggtgaaacgtgtggtgttaacatcttcatgctcttccataagataccgtgacgatgtgcaacaaatttctcctcttaatgaatctcattggagtgattctgaatactgcaaacgctataacctgtggtatgcatatgcaaagactttaggagaaaaagaagcatggaggattgcaaaggaaagtggaattgatctagttgtagttaacccctcttttgtt

SEQ ID NO: 152 - DNA, 574 bp, Trifolium repens
  misc_feature (40)..(40): Any nucleotide
gagatgcctgagttttgtgttacagggggcactggcttcntagcagcttacctagtgaaagccttattagaaaagggtcacacagtaaggactactgtaagaaacccagatgctttggagaaggttggttatctaactgaacttagtgaagacaaagagagattgaagattttaaaagcagatctattggtggaagggagttttgatgaggcagtgagtggtgttgatggtgtgtttcatacagcttcccctgttcttgttccacatgatgacaacattcaggttactttgattgatccatgtataaaaggaacacaaaatgtgcttaactcatgcatcatagcaaaggtgaaacgtgtggtgttaacatcttcatgctcttccataagataccgtgacgatgtgcaacaaatttctcctcttaatgaatctcattggagtgattctgaatactgcaaacgctataacctgtggtatgcatatgcaaagactttaggagaaaaagaagcatggaggattgcaaaggaaagtggaattgatctagttgtagttaacccctcttttgttggtggtc

SEQ ID NO: 153 - DNA, 641 bp, Trifolium repens
  misc_feature (2)..(2): Any nucleotide
  misc_feature (8)..(8): Any nucleotide
  misc_feature (28)..(28): Any nucleotide
  misc_feature (505)..(505): Any nucleotide
  misc_feature (565)..(565): Any nucleotide
  misc_feature (608)..(608): Any nucleotide
  misc_feature (615)..(616): Any nucleotides
  misc_feature (626)..(628): Any nucleotides
  misc_feature (632)..(632): Any nucleotide
  misc_feature (641)..(641): Any nucleotide
gngaaganctagtttgcgtaacccggancaacggtttcatcggaacatggctagttaaaaccctactccaaaaacactacaaaattcacgccacaatcttccccaattccaacgcatctcatctcttcacactccacccggaagctcaatcccggatcacaattttccctgtcgatatcctcgactccaccgccgtcttctccgctatcaataactgctcaggtgtctttcatgccgcttctccatgtaccctcgaagatccaactgatccgcaaaaagagcttctagaacctgctgtacaaggaaccctaaatgttctagaagcatccagcgcgcaggtaccaaaccctaattggccggagaaaaaggcgatcgatgaggcgtcgtggacggatgttgagtactgtaaattgagagggaagtggtatctggtgtcgaaaacggaggcggagaaggcggcttgggattttcgagagaaaaatggtggtgttgatgtgggggcggntcatccggggacttgtttgggagagttgatacagaaggagttgaatgcgagttcagcggntttacagaggttgatgatggggagtgaggatactcaagagtgntattggnnggggggctgnnnatgntaaagatgn

SEQ ID NO: 154 - protein, 206 aa, Trifolium repens
  MISC_FEATURE (2)..(2): Any amino acid
  MISC_FEATURE (9)..(9): Any amino acid
  MISC_FEATURE (168)..(168): Any amino acid
  MISC_FEATURE (201)..(201): Any amino acid
  MISC_FEATURE (204)..(204): Any amino acid
EXLVCVTRXNGFIGTWLVKTLLQKHYKIHATIFPNSNASHLFTLHPEAQSRITIFPVDILDSTAVFSAINNCSGVFHAASPCTLEDPTDPQKELLEPAVQGTLNVLEASSAQVPNPNWPEKKAIDEASWTDVEYCKLRGKWYLVSKTEAEKAAWDFREKNGGVDVGAXHPGTCLGELIQKELNASSALQRLMMGSEDTQEXYWXGG

SEQ ID NO: 155 - DNA, 822 bp, Trifolium repens
  misc_feature (3)..(3): Any nucleotide
  misc_feature (17)..(17): Any nucleotide
  misc_feature (26)..(26): Any nucleotide
  misc_feature (574)..(574): Any nucleotide
  misc_feature (601)..(601): Any nucleotide
  misc_feature (614)..(614): Any nucleotide
  misc_feature (619)..(619): Any nucleotide
  misc_feature (692)..(693): Any nucleotides
  misc_feature (729)..(730): Any nucleotides
  misc_feature (743)..(743): Any nucleotide
  misc_feature (752)..(752): Any nucleotide
  misc_feature (756)..(757): Any nucleotides
  misc_feature (777)..(777): Any nucleotide
  misc_feature (779)..(780): Any nucleotides
  misc_feature (789)..(789): Any nucleotide
  misc_feature (794)..(794): Any nucleotide
  misc_feature (797)..(797): Any nucleotide
  misc_feature (812)..(813): Any nucleotides
gcnttgatcagcgtatnaacacacangtcttcccttgagctctgtttctccacatgtcgaagctagtttgcgtcaccggcggcagcggatgcatcggttcatggctagtccatctccttctcctccgcggctacactgttcacgccaccgtccaaaatctcaatgatgagaacgaaacgaagcatctagaagctctcgaaggagcacaaactaatctccgtctcttccagatcgatctccttaactacgacacaatcctcgctgctgtccgcggttgcgtcggaattttccacctcgcttcaccttgcactgtagacaaagttcatgatcctcagaaggagcttttggatcctgcaattaaagggactttgaatgtgcttactgcagctaaggaagtaggggtgaagcgtgtggttgttacctcgtctgtctcggcgattactcctagtcctgattggccttctgatgttgttaaaagagaggattgttggactgatgttgaatattgcaagaaaaaagagttggggtatccgttgtccaaaacattggctgaaaaagctgcgtgggatttttncaaagaaaatggtttggatgttgttgnggtgaatcccggnactgngatgggtcctgtttttccaccacggcataatgcaagcatgctcatgccttgggaaacttttttgaaggctggnnctgaaacatttgaagactattttatgggattggccnnctttaaagatgtngcattggcncatnntttggggtatgagaacaaanannctttggganacatnggngggttgaaactatcnntccttacgg

SEQ ID NO: 156 - protein, 256 aa, Trifolium repens
  MISC_FEATURE (174)..(174): Any amino acid
  MISC_FEATURE (183)..(183): Any amino acid
  MISC_FEATURE (187)..(187): Any amino acid
  MISC_FEATURE (189)..(189): Any amino acid
  MISC_FEATURE (213)..(214): Any amino acids
  MISC_FEATURE (226)..(226): Any amino acid
  MISC_FEATURE (230)..(230): Any amino acid
  MISC_FEATURE (233)..(233): Any amino acid
  MISC_FEATURE (235)..(235): Any amino acid
  MISC_FEATURE (242)..(243): Any amino acids
  MISC_FEATURE (246)..(248): Any amino acids
  MISC_FEATURE (253)..(254): Any amino acids
MSKLVCVTGGSGCIGSWLVHLLLLRGYTVHATVQNLNDENETKHLEALEGAQTNLRLFQIDLLNYDTILAAVRGCVGIFHLASPCTVDKVHDPQKELLDPAIKGTLNVLTAAKEVGVKRVVVTSSVSAITPSPDWPSDVVKREDCWTDVEYCKKKELGYPLSKTLAEKAAWDFXKENGLDVVXVNPXTXMGPVFPPRHNASMLMPWETFLKAXXETFEDYFMGLAXFKDXALXHXLGYENKXXLGXXXGLKLXXLT

SEQ ID NO: 157 - DNA, 535 bp, Trifolium repens
  misc_feature (3)..(3): Any nucleotide
  misc_feature (17)..(17): Any nucleotide
  misc_feature (26)..(26): Any nucleotide
  misc_feature (52)..(52): Any nucleotide
gcnttgatcagcgtatnaacacacangtcttcccttgagctctgtttctccncatgtcgaagctagtttgcgtcaccggcggcagcggatgcatcggttcatggctagtccatctccttctcctccgcggctacactgttcacgccaccgtccaaaatctcaatgatgagaacgaaacgaagcatctagaagctctcgaaggagcacaaactaatctccgtctcttccagatcgatctccttaactacgacacaatcctcgctgctgtccgcggttgcgtcggaattttccacctcgcttcaccttgcactgtagacaaagttcatgatcctcagaaggagcttttggatcctgcaattaaagggactttgaatgtgcttactgcagctaaggaagtaggggtgaagcgtgtggttgttacctcgtctgtctcggcgattactcctagtcctgattggccttctgatgttgttaaaagagaggattgttggactgatgttgaatattgcaagaaaaaagagttgtggtatccgtt

SEQ ID NO: 158 - DNA, 801 bp, Trifolium repens
  misc_feature (1)..(1): Any nucleotide
  misc_feature (5)..(6): Any nucleotides
  misc_feature (62)..(62): Any nucleotide
  misc_feature (553)..(553): Any nucleotide
  misc_feature (580)..(580): Any nucleotide
  misc_feature (593)..(593): Any nucleotide
  misc_feature (598)..(598): Any nucleotide
  misc_feature (671)..(672): Any nucleotides
  misc_feature (708)..(709): Any nucleotides
  misc_feature (722)..(722): Any nucleotide
  misc_feature (731)..(731): Any nucleotide
  misc_feature (735)..(736): Any nucleotides
  misc_feature (756)..(756): Any nucleotide
  misc_feature (758)..(759): Any nucleotides
  misc_feature (768)..(768): Any nucleotide
  misc_feature (773)..(773): Any nucleotide
  misc_feature (776)..(776): Any nucleotide
  misc_feature (791)..(792): Any nucleotides
nacanntcttcccttgagctctgtttctccacatgtcgaagctagtttgcgtcaccggcggnggcggatgcatcggttcatggctagtccatctccttctcctccgcggctacactgttcacgccaccgtccaaaatctcaatgatgagaacgaaacgaagcatctagaagctctcgaaggagcacaaactaatctccgtctcttccagatcgatctccttaactacgacacaatcctcgctgctgtccgcggttgcgtcggaattttccacctcgcttcaccttgcactgtagacaaagttcatgatcctcagaaggagcttttggatcctgcaattacagggactttgaatgtgcttactgcagctaaggaagtaggggtgaagcgtgtggttgttacctcgtctgtctcggcgattactcctagtcctgattggccttctgatgttgttaaaagagaggattgttggactgatgttgaatattgcaagaaaaaagagttggggtatccgttgtccaaaacattggctgaaaaagctgcgtgggatttttncaaagaaaatggtttggatgttgttgnggtgaatcccggnactgngatgggtcctgtttttccaccacggcataatgcaagcatgctcatgccttgggaaacttttttgaaggctggnnctgaaacatttgaagactattttatgggattggccnnctttaaagatgtngcattggcncatnntttggggtatgagaacaaanannctttggganacatnggngggttgaaactatcnntccttacgg

SEQ ID NO: 159 - DNA, 582 bp, Trifolium repens
gtcacttatgaaatggaacacaaaggtggagacaaagtatgtgtgacaggggcatcaggctttttagcatcttggcttattaagaaacttcttttgtctggctatcaagtcattggaacagttagagatttagggaagaagaagaaagttgaacatttatggaaattggaaggagcaacagaaagactagaactaatccaagctgatttaatggaagaaaatagtttcgacaaagcgatcatgggatgcaaaggtgtcttccacattgcctctccagtactcaatcatatatcagataatcctaaggcggaaatcttggaaccggcagtccaaggtacgctaaatgtgttgcgttcttgtaagaggaaccccgatcttgttcgagtggtgctagcctcatcatcttcggctgttagagtaagagctgattttgatccaagcataccaattgatgaatcatcttggagctccttggaattgtgcgagaaactcaaggcatggtacccaatgtcaaagacaatggcagaaaaagcagcttgggaatatagcaaagagaatggaatagacttagtgactattttc

SEQ ID NO: 160 - protein, 190 aa, Trifolium repens
MEHKGGDKVCVTGASGFLASWLIKKLLLSGYQVIGTVRDLGKKKKVEHLWKLEGATERLELIQADLMEENSFDKAIMGCKGVFHIASPVLNHISDNPKAEILEPAVQGTLNVLRSCKRNPDLVRVVLASSSSAVRVRADFDPSIPIDESSWSSLELCEKLKAWYPMSKTMAEKAAWEYSKENGIDLVTIF

SEQ ID NO: 161 - DNA, 572 bp, Trifolium repens
  misc_feature (2)..(2): Any nucleotide
  misc_feature (4)..(5): Any nucleotides
  misc_feature (9)..(9): Any nucleotide
  misc_feature (11)..(11): Any nucleotide
  misc_feature (13)..(13): Any nucleotide
  misc_feature (24)..(24): Any nucleotide
  misc_feature (39)..(39): Any nucleotide
  misc_feature (47)..(47): Any nucleotide
tncnngctncntncgggcagagantttccctgacctatntgttactnaagaatatttctatatatatatttgtgtttcaagaacccaaaaaatagaatagtgatggaaaggagttgcaaggtttgtgtcaccggtggtgctggttatattggttctcttttagtcaaaaagcttttggaaaagggttacaccgttcatgctactcttagaaacttgaaggacgaatccaaagtagattttttgagaggctttccacatgcagatactagacttatgttatttgaagctgatatatacaaatcagatgaattttggcccgcaattcaaggttgtgagtttgtttttcaccttgctactccttttcaacatcaaactgattctcagtttaagagcatagaggaagctgcaatagcaggggtaaaaagcatagctgaaaattgcataaaatcaggaacagtgagaaaattgatatacactggaactgtaattgcttcttcttctctgaaagatgatggaagtggctacaaagacttcattgatgaaacttgttggacacctctccatcttcctct

SEQ ID NO: 162 - protein, 156 aa, Trifolium repens
MERSCKVCVTGGAGYIGSLLVKKLLEKGYTVHATLRNLKDESKVDFLRGFPHADTRLMLFEADIYKSDEFWPAIQGCEFVFHLATPFQHQTDSQFKSIEEAAIAGVKSIAENCIKSGTVRKLIYTGTVIASSSLKDDGSGYKDFIDETCWTPLHLP

SEQ ID NO: 163 - DNA, 714 bp, Trifolium repens
  misc_feature (4)..(4): Any nucleotide
  misc_feature (131)..(131): Any nucleotide
  misc_feature (147)..(147): Any nucleotide
gccnttgcctactactaaactatatattattattatattatatgatgatacatagtgacattaataattggaagggagaataaatagttgaaaaacacacagttggagtgtttttgttgttaaagaagctngaaaatggaggaagcnacaaagatggtgaaaaagagtggacaaattgttcctactgccaaatactgtgttacaggagcaacaggctatattggttcatggcttgttgaagctcttcttcaaagaggttgcactgttcatgctactgttagagatcctgaaaaatcgttacacctcctgtcgttgtggaaaggtagtgaccaattgagaattttccgtgcggatttgcaagaagaaggaagtttcgatgatgccgtaaaaggatgtattggtgtgttccatgttgcagcttcaatgcaattcaatattagtgacaaagaaaacactgaggactttgttgaagcaaatataattgaccctgcaatcaaaggaaccataaatcttctcaaatcatgcttgaaatcaaattcagtgaaaagggttgttttcacatcttccataagtactattactgctaaagacaacgacggaaaatggaaacctattgttgatgaatcttgccaaacaaaaactgagattctgtggaatacacaaccaagtggatgggtttatgcactttcaaagcttcatgcagaagaagcggct

SEQ ID NO: 164 - protein, 187 aa, Trifolium repens
MVKKSGQIVPTAKYCVTGATGYIGSWLVEALLQRGCTVHATVRDPEKSLHLLSLWKGSDQLRIFRADLQEEGSFDDAVKGCIGVFHVAASMQFNISDKENTEDFVEANIIDPAIKGTINLLKSCLKSNSVKRVVFTSSISTITAKDNDGKWKPIVDESCQTKTEILWNTQPSGWVYALSKLHAEEAA

SEQ ID NO: 165 - DNA, 289 bp, Trifolium repens
  misc_feature (4)..(4): Any nucleotide
gccnttgcctactactaaactatatattattattatattatatgatgatacatagtgacattaataattggaagggagaataaatagttgaaaaacacacagttggagtgtttttgttgttaaagaagctataaaatggaggaaacaacaaagatggtgaaaaatagtggacaaattgttcctatagccaaatactgtgtcacaggagccacaggctatattggttcatggcttgttgaagctcttcttcaaagaggttgcactgttcatgctactgttagagatcctg

SEQ ID NO: 166 - DNA, 591 bp, Trifolium repens
  misc_feature (8)..(8): Any nucleotide
  misc_feature (23)..(24): Any nucleotides
agaagctngaaaatggaggaagnnacaaagatggtgaaaaagagtggacaaattgttcctactgccaaatactgtgttacaggagcaacaggctatattggttcatggcttgttgaagctcttcttcaaagaggttgcactgttcatgctactgttagagatcctgaaaaatcgttacacctcctgtcgttgtggaaaggtagtgaccaattgagaattttccgtgcggatttgcaagaagaaggaagtttcgatgatgccgtaaaaggatgtattggtgtgttccatgttgcagcttcaatgcaattcaatattagtgacaaagaaaacactgaggactttgttgaagcaaatataattgaccctgcaatcaaaggaaccataaatcttctcaaatcatgcttgaaatcaaattcagtgaaaagggttgttttcacatcttccataagtactattactgctaaagacaacgacggaaaatggaaacctattgttgatgaatcttgccaaacaaaaactgagattctgtggaatacacaaccaagtggatgggtttatgcactttcaaagcttcatgcagaagaagcggct

SEQ ID NO: 167 - DNA, 572 bp, Trifolium repens
  misc_feature (3)..(3): Any nucleotide
  misc_feature (19)..(19): Any nucleotide
ctngaaaatggaggaagcnacaaagatggtgaaaaagagtggacaaattgttcctactgccaaatactgtgttacaggagcaacaggctatattggttcatggcttgttgaagctcttcttcaaagaggttgcactgttcatgctactgttagagatcctgaaaaatcgttacacctcctgtcgttgtggaaaggtagtgaccaattgagaattttccgtgcggatttgcaagaagaaggaagtttcgatgatgccgtaaaaggatgtattggtgtgttccatgttgcagcttcaatgcaattcaatattagtgacaaagaaaacactgaggactttgttgaagcaaatataattgaccctgcaatcaaaggaaccataaatcttctcaaatcatgcttgaaatcaaattcagtgaaaagggttgttttcacatcttccataagtactattactgctaaagacaacgacggaaaatggaaacctattgttgatgaatcttgccaaacaaaaactgagattctgtggaatacacaaccaagtggatgggtttatgcactttcaaagcttcatg

SEQ ID NO: 168 - DNA, 976 bp, Trifolium repens
  misc_feature (2)..(3): Any nucleotides
  misc_feature (5)..(5): Any nucleotide
  misc_feature (16)..(16): Any nucleotide
  misc_feature (22)..(22): Any nucleotide
  misc_feature (25)..(25): Any nucleotide
gnngngtcttccgttnaatttnagnctatattgaaaaggaaaaaaagagtagagaagtgaagtgaagtgaaaacatacatgggttccgaatcagaaatagtttgtgttaccggagcttcaggtttcatcggatcgtggcttgttatgagacttatagagcgtggctacacggttcgagccaccgttcgcgacccagataacatgaagaaggtgaagcatttggtggaactgccgggtgcaaaaagcaaattgtctctttggaaggctgatcttgataaagaggggagttttgatgaagcaattaaagggtgcacaggagtttttcatgttgctacaccaatggattttgaatccaaggaccctgagaatgaagtgataaagcctacaataaatggattaatagacatactgaaagcatgcgaaaaggcaaaaacagttagaaaattggttttcacatcatcggctggaactgtggacgttactgaacatccaaagtctattattgatgaaacatgctggagtgacgttgacttttgccgtagagtcaagatgaccggttggatgtattttgtttcaaagaccctagcagagcaagaagcttggaagtattcgaaagagcacaacatagactttgtctccatcattccacctcttgttgttggcccctttcttatggcctcaatgccacctagtctaatcactgctctttctcttatcacaggaaatgaggcccattactcaatcataaagcaagggcaatacgtccatttagatgacctttgtcttgctcatatatttctgtatgagaatccaaaagctcaagggagatacatttgctgttcacatgaagcaaccattcatcaagttgcaaaacttattaaagaaaaatacccagagttcaatgtcccaacaaaattcaatgatatcccagatgaattggaaattattaaattttctaaaaagaagatcacagact

SEQ ID NO: 169 - protein, 299 aa, Trifolium repens
MGSESEIVCVTGASGFIGSWLVMRLIERGYTVRATVRDPDNMKKVKHLVELPGAKSKLSLWKADLDKEGSFDEAIKGCTGVFHVATPMDFESKDPENEVIKPTINGLIDILKACEKAKTVRKLVFTSSAGTVDVTEHPKSIIDETCWSDVDFCRRVKMTGWMYFVSKTLAEQEAWKYSKEHNIDFVSIIPPLVVGPFLMASMPPSLITALSLITGNEAHYSIIKQGQYVHLDDLCLAHIFLYENPKAQGRYICCSHEATIHQVAKLIKEKYPEFNVPTKFNDIPDELEIIKFSKKKITD

SEQ ID NO: 170 - DNA, 586 bp, Trifolium repens
  misc_feature (2)..(3): Any nucleotides
  misc_feature (16)..(16): Any nucleotide
  misc_feature (22)..(22): Any nucleotide
  misc_feature (25)..(25): Any nucleotide
  misc_feature (53)..(55): Any nucleotides
  misc_feature (57)..(58): Any nucleotides
gnnttgtcttccgttnaatttnagnctatattgaaaaagaaaaaaagagtagnnnanngaagtgaagtgaaaacatacatgggttccgaatcagaaatagtttgtgttaccggagcttcatgtttcatcggatcgtggcttgttatgagacttatagagcgtggctacacggttcgagccaccgttcgcgacccagataacatgaagaaggtgaagcatttggtggaactgccgggtgcaaaaagcaaattgtctctttggaaggctgatcttgataaagaggggagttttgatgaagcaattaaagggtgcacaggagtttttcatgttgctacaccaatggattttgaatccaaggaccctgagaatgaagtgataaagcctacaataaatggattaatagacatactgaaagcatgcgaaaaggcaaaaacagttaaaaaattggttttcacatcatcggctggaactgtggacgttactgaacatccaaagtctattattgatgaaacatgctggagtgacgttgacttttgccgtagagtcaagatgaccggttggatgtattttgtttcaaagaccctag

SEQ ID NO: 171 - DNA, 569 bp, Trifolium repens
  misc_feature (24)..(24): Any nucleotide
  misc_feature (209)..(209): Any nucleotide
ttttgtcttaaatccaatttcagnctaaattgaaaaggaaaaaaagaggagagaagtcaactggagtgaaaatatacatgggttctgaatcggaaatagtttgtgttaccggagcttcaggtttcatcgggtcgtggcttgttatgagacttatggagcatggctacactgttcgagccaccgttcgtgacccagataacatgaagaangtgaagcatttgctggaactgccaggtgcaaaaagcaaattgtctctttggaaggctgatcttgataaagaggggagttttgatgaagcaattaaagggtgcacaggagtttttcatgttgctacaccaatggattttgagtccaaggaccctgagaatgaagtgataaagcctacaataaacggattaatagacatactgaaagcatgcgaaaaggcaaaaacagttagaaaattggttttcacatcatcggctggaactgtggacgttactgaacatccaaagtctattattgatgaaacatgctggagtgacgttgacttttgccgtagagtcaaaatgaccggttggatgtatttt

SEQ ID NO: 172 - DNA, 493 bp, Trifolium repens
  misc_feature (2)..(2): Any nucleotide
  misc_feature (13)..(13): Any nucleotide
  misc_feature (19)..(19): Any nucleotide
  misc_feature (22)..(22): Any nucleotide
  misc_feature (50)..(52): Any nucleotides
  misc_feature (54)..(55): Any nucleotides
  misc_feature (69)..(69): Any nucleotide
  misc_feature (102)..(102): Any nucleotide
  misc_feature (123)..(123): Any nucleotide
  misc_feature (154)..(154): Any nucleotide
  misc_feature (161)..(161): Any nucleotide
  misc_feature (322)..(322): Any nucleotide
  misc_feature (418)..(418): Any nucleotide
  misc_feature (464)..(464): Any nucleotide
  misc_feature (493)..(493): Any nucleotide
gngtcttccgttnaatttnagnctatattgaaaaagaaaaaaagagtagnnnanngaagtgaagtgaanacatacatgggttccgaatcagaaatagtttgngttaccggagcttcatgtttnatcggatcgtggcttgttatgagacttatanagcgtgnctacacggctcgagccaccgttcgcgacccagataacatgaagaaggtgaagcatttggtggaactgccgggtgcaaaaagcaaattgtctctttggaaggctgatcttgataaagaggggagttttgatgaagcaattaaagggtgcacaggagtttttnatgttgctacaccaatggattttgaatccaaggaccctgagaatgaagtgataaagcctacaataaatggattaatagacatactgaaagcatgcnaaaaggcaaaaacagttaaaaaattggttttcacatcatcggctgnaactgtggacgttactgaacatccaaagn

SEQ ID NO: 173 - DNA, 580 bp, Trifolium repens
  misc_feature (2)..(2): Any nucleotide
  misc_feature (13)..(13): Any nucleotide
  misc_feature (19)..(19): Any nucleotide
  misc_feature (22)..(22): Any nucleotide
  misc_feature (54)..(55): Any nucleotides
  misc_feature (57)..(59): Any nucleotides
  misc_feature (539)..(539): Any nucleotide
  misc_feature (546)..(546): Any nucleotide
  misc_feature (576)..(576): Any nucleotide
gngtcttccgttnaatttnagnctatattgaaaaagaaaaaaagagtagagaanngnnntgaagtgaaaacatacatgggttccgaatcagaaatagtttgtgttaccggagcttcatgtttcatcggatcgtggcttgttatgagacttatagagcgtggctacacggttcgagccaccgttcgcgacccagataacatgaagaaggtgaagcatttggtggaactgccgggtgcaaaaagcaaattgtctctttggaaggctgatcttgataaagaggggagttttgatgaagcaattaaagggtgcacaggagtttttcatgttgctacaccaatggattttgaatccaaggaccctgagaatgaagtgataaagcctacaataaatggattaatagacatactgaaagcatgcgaaaaggcaaaaacagttaaaaaattggttttcacatcatcggctggaactgtggacgttactgaacatccaaagtctattattgatgaaacatgctggagtgacgttgacttttgccgtanagtcaanatgaccggctggatgtattttgtttcaaanaccc

SEQ ID NO: 174 - DNA, 581 bp, Trifolium repens
  misc_feature (2)..(2): Any nucleotide
  misc_feature (13)..(13): Any nucleotide
  misc_feature (22)..(22): Any nucleotide
  misc_feature (36)..(36): Any nucleotide
  misc_feature (50)..(52): Any nucleotides
  misc_feature (54)..(55): Any nucleotides
gngtcttccgttnaatttaagnctatattgaaaagnaaaaaaagagtagnnnanngaagtgaagtgaaaacatacatgggttccgaatcagaaatagtttgtgttaccggagcttcaggtttcatcggatcgtggcttgttatgagacttatagagcgtggctacacggttcgagccaccgttcgcgacccagataacatgaagaaggtgaagcatttggtggaactgccgggtgcaaaaagcaaattgtctctttggaaggctgatcttgataaagaggggagttttgatgaagcaattaaagggtgcacaggagtttttcatgttgctacaccaatggattttgaatccaaggaccctgagaatgaagtgataaagcctacaataaatggattaatagacatactgaaagcatgcgaaaaggcaaaaacagttagaaaattggttttcacatcatcggctggaactgtggacgttactgaacatccaaagtctattattgatgaaacatgctggagtgacgttgacttttgccgtagagtcaagatgaccggttggatgtattttgtttcaaagaccct

SEQ ID NO: 175 - DNA, 592 bp, Trifolium repens
  misc_feature (2)..(2): Any nucleotide
  misc_feature (13)..(13): Any nucleotide
  misc_feature (16)..(16): Any nucleotide
  misc_feature (22)..(22): Any nucleotide
  misc_feature (36)..(36): Any nucleotide
  misc_feature (50)..(52): Any nucleotides
  misc_feature (54)..(55): Any nucleotides
gngtcttccgttnaanttaagnctatattgaaaagnaaaaaaagagtagnnnanngaagtgaagtgaaaacatacatgggttccgaatcagaaatagtttgtgttaccggagcttcaggtttcatcggatcgtggcttgttatgagacttatagagcgtggctacacggttcgagccaccgttcgcgacccagataacatgaagaaggtgaagcatttggtggaactgccgggtgcaaaaagcaaattgtctctttggaaggctgatcttgataaagaggggagttttgatgaagcaattaaagggtgcacaggagtttttcatgttgctacaccaatggattttgaatccaaggaccctgagaatgaagtgataaagcctacaataaatggattaatagacatactgaaagcatgcgaaaaggcaaaaacagttagaaaattggttttcacatcatcggctggaactgtggacgttactgaacatccaaagtctattattgatgaaacatgctggagtgacgttgacttttgccgtagagtcaagatgaccggttggatgtattttgtttcaaagaccctagcagagcaag

SEQ ID NO: 176 - DNA, 598 bp, Trifolium repens
  misc_feature (2)..(2): Any nucleotide
  misc_feature (13)..(13): Any nucleotide
  misc_feature (19)..(19): Any nucleotide
  misc_feature (22)..(22): Any nucleotide
gngtcttccgttnaatttnagnctatattgaaaaagaaaaaaagagtagagaagtgaagtgaagtgaaaacatacatgggttctgaatcagaaatagtttgtgttaccggagcatcaggtttcatcggatcgtggcttgttatgagacttatagagcgtggctacacggttcgagccactgttcgcgacccagataacatgaagaaggtgaagcatttggtggaactgccgggtgcaaaaagcaaattgtctctttggaaggctgatcttgataaagaggggagttttgatgaagcaattaaagggtgcacaggagtttttcatgttgctacaccaatggattttgaatccaaggaccctgagaatgaagtgataaagcctacaataaatggattaatagacatactgaaagcatgcgaaaaggcaaaaacagttaaaaaattggttttcacatcatcggctggaactgtggacgttactgaacatccaaagtctattattgatgaaacatgctggagtgacgttgacttttgccgtagagtcaagatgaccggttggatgtattttgtttcaaagaccctagcagagcaagaagctt

SEQ ID NO: 177 - DNA, 576 bp, Trifolium repens
  misc_feature (9)..(9): Any nucleotide
  misc_feature (12)..(12): Any nucleotide
  misc_feature (18)..(18): Any nucleotide
  misc_feature (21)..(21): Any nucleotide
ggtcttccnttnaattcnagncgaaattgaaaaggaaaaaaagaggagagaagtgaactgaagtgaaaatatacatgggttccgaatcggaaatagtttgtgttaccggagcttcaggtttcatcgggtcgtggcttgttatgagacttatggagcgcggctacacggttcgagccactgttcgcgacccagataacatgaagaaggtgaagcatttgatggaactgccgggtgcaaaaagcaaattgtctctttggaaggctgatcttgataaagaggggagttttgatgaagcaattaaagggtgcacaggagtttttcatgttgctacaccaatggattttgaatccaaggaccctgagaacgaagtgataaagcctacaataaatggactaatagacatactgagagcatgtgaaaaggcaaaaacaattagaagattggttttcacatcatcagctggaactgtggacgtaactgaacactcaaaatcaattgttgatgaaacatgttggagtgacgttgacttttgccgtagagtcaaaatgaccggttggatgtattttgtttcaaaga

SEQ ID NO: 178 - DNA, 587 bp, Trifolium repens
  misc_feature (12)..(12): Any nucleotide
  misc_feature (21)..(21): Any nucleotide
ggtcttccgttnaatttaagnctatattgaaaaagaaaaaaagagtagagaagtgaagtgaagtgaaaacatacatgggttctgaatcagaaatagtttgtgttaccggagcatcaggtttcatcggatcgtggcttgttatgagacttatagagcgtggctacacggttcgagccactgttcgcgacccagataacatgaagaaggtgaagcatttggtggaactgccgggtgcaaaaagcaaattgtctctttggaaggctgatcttgataaagaggggagttttgatgaagcaattaaagggtgcacaggagtttttcatgttgctacaccaatggattttgaatccaaggaccctgagaatgaagtgataaagcctacaataaatggattaatagacatactgaaagcatgcgaaaaggcaaaaacagttaaaaaattggttttcacatcatcggctggaactgtggacgttactgaacatccaaagtctattattgatgaaacatgctggagtgacgttgacttttgccgtagagtcaagatgaccggttggatgtattttgtttcaaagaccctagcagag

SEQ ID NO: 179 - DNA, 630 bp, Trifolium repens
  misc_feature (12)..(13): Any nucleotides
  misc_feature (21)..(21): Any nucleotide
ggtcttccgttnnatttaagnctatattgaaaaagaaaaaaagagtagagaagtgaagtgaagtgaaaacatacatgggttctgaatcagaaatagtttgtgttaccggagcatcaggtttcatcggatcgtggcttgttatgagacttatagagcgtggctacacggttcgagccactgttcgcgacccagataacatgaagaaggtgaagcatttggtggaactgccgggtgcaaaaagcaaattgtctctttggaaggctgatcttgataaagaggggagttttgatgaagcaattaaagggtgcacaggagtttttcatgttgctacaccaatggattttgaatccaaggaccctgagaatgaagtgataaagcctacaataaatggattaatagacatactgaaagcatgcgaaaaggcaaaaacagttaaaaaattggttttcacatcatcggctggaactgtggacgttactgaacatccaaagtctattattgatgaaacatgctggagtgacgttgacttttgccgtagagtcaagatgaccggttggatgtattttgtttcaaagaccctagcagagcaagaagcttggaagtattctaaagagcacaacatagattttg

SEQ ID NO: 180 - DNA, 579 bp, Trifolium repens
  misc_feature (7)..(8): Any nucleotides
  misc_feature (11)..(11): Any nucleotide
  misc_feature (17)..(17): Any nucleotide
  misc_feature (20)..(20): Any nucleotide
gtcttcnnttnaattcnagncgaaattgaaaaggaaaaaaagaggagagaagtgaactgaagtgaaaatatacatgggttccgaatcggaaatagtttgtgttaccggagcttcaggtttcatcgggtcgtggcttgttatgagacttatggagcgcggctacacggttcgagccactgttcgcgacccagataacatgaagaaggtgaagcatttgatggaactgccgggtgcaaaaagcaaattgtctctttggaaggctgatcttgataaagaggggagttttgatgaagcaattaaagggtgcacaggagtttttcatgttgctacaccaatggattttgaatccaaggaccctgagaacgaagtgataaagcctacaataaatggactaatagacatactgagagcatgtgaaaaggcaaaaacaattagaagattggttttcacatcatcagctggaactgtggacgtaactgaacactcaaaatcaattgttgatgaaacatgttggagtgacgttgacttttgccgtagagtcaaaatgaccggttggatgtattttgtttcaaagaccct

SEQ ID NO: 181 - DNA, 604 bp, Trifolium repens
  misc_feature (12)..(12): Any nucleotide
  misc_feature (17)..(17): Any nucleotide
  misc_feature (20)..(20): Any nucleotide
  misc_feature (34)..(34): Any nucleotide
  misc_feature (52)..(53): Any nucleotides
  misc_feature (55)..(57): Any nucleotides
gtcttccgttcnatttnagnctatattgaaaagnaaaaaaagagtagagaanngnnntgaagtgaaaacatacatgggttccgaatcagaaatagtttgtgttaccggagcttcaggtttcatcggatcgtggcttgttatgagacttatagagcgtggctacacggttcgagccaccgttcgcgacccagataacatgaagaaggtgaagcatttggtggaactgccgggtgcaaaaagcaaattgtctctttggaaggctgatcttgataaagaggggagttttgatgaagcaattaaagggtgcacaggagtttttcatgttgctacaccaatggattttgaatccaaggaccctgagaatgaagtgataaagcctacaataaatggattaatagacatactgaaagcatgcgaaaaggcaaaaacagttagaaaattggttttcacatcatcggctggaactgtggacgttactgaacatccaaagtctattattgatgaaacatgctggagtgacgttgacttttgccgtagagtcaagatgaccggttggatgtattttgtttcaaagaccctagcagagcaagaagcttggaagtat

SEQ ID NO: 182 - DNA, 586 bp, Trifolium repens
  misc_feature (10)..(10): Any nucleotide
ggtcttcttnaatccagctaaattgaaaaggaaaaaaagaggagagaagtgaactggagtgaaaatatacatgggttctgaatcggaaatagtttgtgttaccggagcttcaggtttcatcgggtcgtggcttgttatgagacttatggagcgtggctacactgttcgagccaccgttcgtgacccagataacatgaagaaggtgaagcatttgctggaactgccgggtgcaaaaagcaaattgtctctttggaaggctgatcttgataaagaggggagttttgatgaagcaattaaagggtgcacaggagtttttcatgttgctacaccaatggattttgaatccaaggaccctgagaatgaagtgataaagcctacaataaacggattaatagacatactgaaagcatgcgaaaaggcaaaaacagttagaaaattggttttcacatcatcggctggaactgtggacgttactgaacatccaaagtctattattgatgaaacatgctggagtgacgttgacttttgccgtagagtcaaaatgaccggttggatgtattttgtttcaaagaccctagcagagcag

SEQ ID NO: 183 - DNA, 586 bp, Trifolium repens
  misc_feature (2)..(2): Any nucleotide
  misc_feature (11)..(11): Any nucleotide
gnagagaagtnacctggagtgaaaatatacatgggttctgaatcggaaatagtttgtgttaccggagcttcaggtttcatcgggtcgtggcttgttatgagacttatggagcgtggctacactgttcgagccaccgttcgtgacccagataacatgaagaaggtgaagcatttgctggaactgccgggtgcaaaaagcaaattgtctctttggaaggctgatcttgataaagaggggagttttgatgaagcaattaaagggtgcacaggagtttttcatgttgctacaccaatggattttgagtccaaggaccctgagaatgaagtgataaagcctacaataaacggattaatagacatactgaaagcatgcgaaaaggcaaaaacagttagaaaattggttttcacatcatcggctggaactgtggacgttactgaacatccaaagtctattattgatgaaacatgctggagtgacgttgacttttgccgtagagtcaaaatgaccggttggatgtattttgtttcaaagaccctagcagagcaagaagcttggaagtattcgaaagagcacaacatagactttg

SEQ ID NO: 184 - DNA, 570 bp, Trifolium repens
  misc_feature (10)..(11): Any nucleotides
  misc_feature (23)..(23): Any nucleotide
tactgaaagnntgcgaaaaggcnaaaacagttagaaaattggttttcacatcatcggctggaactgtggacgttactgaacatccaaagtctattattgatgaaacatgctggagtgacgttgacttttgccgtagagtcaaaatgaccggttggatgtattttgtttcaaagaccctagcagagcaagaagcttggaagtattcgaaagagcacaacatagactttgtctccatcattccacctcttgttgttggcccctttcttatggcctcaatgccacctagtctaatcactgctctttctcttatcacaggaaatgaggcccattactcaatcataaagcaagggcaatacgtccatttagatgacctttgtcttgctcatatatttctgtatgagaatccaaaagctcaagggagatacatttgctgttcacatgaagcaaccattcatcaagttgcaaaacttattaaagaaaaatacccagagttcaatgtcccaacaaaattcaatgatatcccagatgaattggaaattattaaattttctaaaaagaagatcacagact

SEQ ID NO: 185 - DNA, 833 bp, Trifolium repens
  misc_feature (3)..(3): n is a, c, g, or t
  misc_feature (34)..(34): n is a, c, g, or t
ggncataaaaactgcactagtgtgtataagtttnttagtgaaaaaagagtgtgtaaattaacatcatggctagtatcaaacaaattggaaacaagaaagcatgtgtgattggtggcactggttttgttgcatctatgttgatcaaacagttacttgaaaagggttatgctgttaatactactgttagagacccagatagtcctaagaaaatatctcacctagtggcactgcaaagtttgggggaactgaatctatttagagcagacttaacagttgaagaagattttgatgctcctatagcaggatgtgagcttgtttttcaacttgctacacctgtgaactttgcttctcaagatcctgagaatgacatgataaagccagcaatcaaaggtgtgttgaatgtgttgaaagcaagtgcaagagcaaaagaagtcaaaagagttatcttaacatcttcggcagccgcggtgactataaatgaactcaaagggacaggtcatgttatggatgaaaccaactggtcagatgttgaatttctgaacactgcaaagccacccacttggggttatcctgcttcaaaaatgctagctgaaaaggctgcatggaaatttgctgaagaaaatgacattgatctaatcactgtgatacctagtttaacaactggtccttctctcacaccagatatcccatctagtgttggcttggcaatgtctctaataacaggcaatgatttcctcataaatgctctgaaaggaatgcaatttctgtcgggttcgttatccatcactcatgttgaggatatttgccgagctcatatatttctggcagagaag

SEQ ID NO: 186 - protein, 256 aa, Trifolium repens
MASIKQIGNKKACVIGGTGFVASMLIKQLLEKGYAVNTTVRDPDSPKKISHLVALQSLGELNLFRADLTVEEDFDAPIAGCELVFQLATPVNFASQDPENDMIKPAIKGVLNVLKASARAKEVKRVILTSSAAAVTINELKGTGHVMDETNWSDVEFLNTAKPPTWGYPASKMLAEKAAWKFAEENDIDLITVIPSLTTGPSLTPDIPSSVGLAMSLITGNDFLINALKGMQFLSGSLSITHVEDICRAHIFLAEK

SEQ ID NO: 187 - DNA, 576 bp, Trifolium repens
  misc_feature (3)..(3): n is a, c, g, or t
  misc_feature (34)..(34): n is a, c, g, or t
ggncataaaaactgcactagtgtgtataagtttnatagtgaaaaaagagtgtgtaaattaacatcatggctagtatcaaacaaattggaaacaagaaagcatgtgtgattggtggcactggttttgttgcatctatgttgatcaaacagttacttgaaaagggttatgctgttaatactactgttagagacccagatagtcctaagaaaatatctcacctagtggcactgcaaagtttgggggaactgaatctatttagagcagacttaacagttgaagaagattttgatgctcctatagcaggatgtgagcttgtttttcaacttgctacacctgtgaactttgcttctcaagatcctgagaatgacatgataaagccagcaatcaaaggtgtgttgaatgtgttgaaagcaagtgcaagagcaaaagaagtcaaaagagttatcttaacatcttcggcagccgcggtgactataaatgaactcaaagggacaggtcatgttatggatgaaaccaactggtcagatgttgaatttctgaacactgcaaagccacccacttggggttatcctgctt

SEQ ID NO: 188 - DNA, 580 bp, Trifolium repens
  misc_feature (3)..(3): n is a, c, g, or t
  misc_feature (5)..(5): n is a, c, g, or t
  misc_feature (34)..(35): n is a, c, g, or t
  misc_feature (580)..(580): n is a, c, g, or t
ggncntaaaaactgcactagtgtgtataagtttnntagtgaaaaaagagtgtgtaaattaacatcatggctagtatcaaacaaattggaaacaagaaagcatgtgtgattggtggcactggttttgttgcatctatgttgatcaaacagttacttgaaaagggttatgctgttaatactactgttagagacccagatagtcctaagaaaatatctcacctagtggcactgcaaagtttgggggaactgaatctatttagagcagacttaacagttgaagaagattttgatgctcctatagcaggatgtgagcttgtttttcaacttgctacacctgtgaactttgcttctcaagatcctgagaatgacatgataaagccagcaatcaaaggtgtgttgaatgtgttgaaagcaagtgcaagagcaaaagaagtcaaaagagttatcttaacatcttcggcagccgcggtgactataaatgaactcaaagggacaggtcatgttatggatgaaaccaactggtcagatgttgaatttctgaacactgcaaagccacccacttggggttatcctgcttcaan

SEQ ID NO: 189 - DNA, 578 bp, Trifolium repens
  misc_feature (14)..(14): n is a, c, g, or t
  misc_feature (29)..(30): n is a, c, g, or t
taaaaactgtactngtgtgtataagtttnntagtgaaaaaagagtgtgtaaattaacatcatggctagtatcaaacaaattggaaacaagaaagcatgtgtgattggtggcactggttttgttgcatctatgttgatcaaacagttacttgaaaagggttatgctgttaatactactgttagagacccagatagtcctaagaaaatatctcacctagtggcactgcaaagtttgggggaactgaatctatttagagcagacttaacagttgaagaagattttgatgctcctatagcaggatgtgagcttgtttttcaacttgctacacctgtgaactttgcttctcaagatcctgagaatgacatgataaagccagcaatcaaaggtgtgttgaatgtgttgaaagcaagtgcaagagcaaaagaagtcaaaagagttatcttaacatcttcggcagccgcggtgactataaatgaactcaaagggacaggtcatgttatggatgaaaccaactggtcagatgttgaatttctgaacactgcaaagccacccacttggggttatcctgcttcaaaaat

SEQ ID NO: 190 - DNA, 619 bp, Trifolium repens
taaaaactgcactagtgtgtataagtttcttggtgaaaaaagagtttgtaaattaacatcatggctagtatcaaacaaattggaaacaagaaagcatgtgtgattggtggcactggttttgttgcatctatgttgatcaagcagttacttgaaaagggttatgctgttaatactaccgttagagacccagatagccctaagaaaatatctcacctagtggcactgcaaagtttgggggaactgaatctatttagagcagacttaacagttgaagaagattttgatgctcctatagcaggatgtgaacttgtttttcaacttgctacacctgtgaactttgcttctcaagatcctgagaatgacatgataaagccagcaatcaaaggtgtgttgaatgtgttgaaagcaattgcaagagcaaaagaagttaaaagagttatcttaacatcttcggcagccgcggtgactataaatgaactcaaagggacaggtcatgttatggatgaaaccaactggtctgatgttgaatttctcaacactgcaaaaccacccacttggggttatcctgcctcaaaaatgctagctgaaaaggctgcatggaaatttgctgaagaaaatg

SEQ ID NO: 191 - DNA, 619 bp, Trifolium repens
  misc_feature (12)..(12): n is a, c, g, or t
  misc_feature (14)..(14): n is a, c, g, or t
  misc_feature (45)..(45): n is a, c, g, or t
  misc_feature (53)..(53): n is a, c, g, or t
  misc_feature (59)..(59): n is a, c, g, or t
  misc_feature (614)..(614): n is a, c, g, or t
gacctcgtgtgnantagtttcttggtgaaaaaagagtttgtaaantaacatcntggctngtatcaaacaaattggaaacaagaaagcatgtgtgattggtggcactggttttgttgcatctatgttgatcaagcagttacttgaaaagggttatgctgttaatactaccgttagagacccagatagccctaagaaaatatctcacctagtggcactgcaaagtttgggggaactgaatctatttagagcagacttaacagttgaagaagattttgatgctcctatagcaggatgtgaacttgtttttcaacttgctacacctgtgaactttgcttctcaagatcctgagaatgacatgataaagccagcaatcaaaggtgtgttgaatgtgttgaaagcaattgcaagagcaaaagaagttaaaagagttatcttaacatcttcggcagccgcggtgactataaatgaactcaaagggacaggtcatgttatggatgaaaccaactggtctgatgttgaatttctcaacactgcaaaaccacccacttggggttatcctgcctcaaaaatgctagctgaaaaggctgcatggaaatttgctgaagaaaatgacnttgat

SEQ ID NO: 192 - DNA, 586 bp, Trifolium repens
  misc_feature (2)..(2): n is a, c, g, or t
  misc_feature (4)..(4): n is a, c, g, or t
  misc_feature (23)..(23): n is a, c, g, or t
gngnacctgaatctatttagagnagacttaacagttgaagaagattttgatgctcctatagcaggatgtgagcttgtttttcaacttgctacacctgtgacctttgcttctcaagatcctgagaatgacatgataaagccagcaatcaaaggtgtgttgaatgtgttgaaagcaagtgcaagagcaaaagaagtcaaaagagttatcttaacatcttcggcagccgcggtgactataaatgaactcaaagggacaggtcatgttatggatgaaaccaactggtcaggtgttgaatttctgaacactgcaaagccacccacttggggttatcctgcttcaaaaatgctagctgaaaaggctgcatggaaatttgctgaagaaaatgacattgatctaatcactgtgatacctagtttaacaactggtccttctctcacaccagatatcccatctagtgttggcttggcaatgtctctaataacaggcaatgatttcctcataaatgctctgaaaggaatgcaatttctgtcgggttcgttatccatcactcatgttgaggatatttgccgagctcatatatttctgg

SEQ ID NO: 193 - DNA, 567 bp, Trifolium repens
  misc_feature (55)..(55): n is a, c, g, or t
ttaacagttgaagaagattttgatgctcctatagcaggatgtgagcttgtttttnaacttgctacacctgtgacctttgcttctcaagatcctgagaatgacatgataaagccagcaatcaaaggtgtgttgaatgtgttgaaagcaagtgcaagagcaaaagaagtcaaaagagttatcttaacatcttcggcagccgcggtgactataaatgaactcaaagggacaggtcatgttatggatgaaaccaactggtcagatgttgaatttctgaacactgcaaagccacccacttggggttatcctgcttcaaaaatgctagctgaaaaggctgcatggaaatttgctgaagaaaatgacattgatctaatcactgtgatacctagtttaacaactggtccttctctcacaccagatatcccatctagtgttggcttggcaatgtctctaataacaggcaatgatttcctcataaatgctctgaaaggaatgcaatttctgtcgggttcgttatccatcactcatgttgaggatatttgccgagctcatatatttctggcagagaag

SEQ ID NO: 194 - DNA, 597 bp, Trifolium repens
ggaaccaatttgtcggacttttttcccgggttggcccgattcgatttgcagggtgtggtgaaagagatggatgtcttggttccacgttttgatagcatatttgaaaaaatgattggtgaacgtaagaagaaggaagtggaggggaaagaaaatgaaagtaaggattttctgcagtttttgttgaatttgaaggatgagggtgattctaagactccattcacaattacccatgttaaggctctactcatggacatggttgtgggtggatcagacacatcctccaacacaattgagtttgcattggcagaaatgatgaacaacccagaagtaatgaggaaggttcaagaggaattagaagatgtagttgggaaagataacttagtagaagagtctcacattcataagctaccctacttgcatgcagtgatgaaagaaacacttcgtttacacccagcacttccacttttagtccctcactgtccaagtgaaaccaccaatgttggaggctacacaattccaaagggatctcgtgtgtttgtgaacgtttgggctattcatagagacccttccatttgggagaaaccactagaatttgat

SEQ ID NO: 195 - protein, 199 aa, Trifolium repens
GTNLSDFFPGLARFDLQGVVKEMDVLVPRFDSIFEKMIGERKKKEVEGKENESKDFLQFLLNLKDEGDSKTPFTITHVKALLMDMVVGGSDTSSNTIEFALAEMMNNPEVMRKVQEELEDVVGKDNLVEESHIHKLPYLHAVMKETLRLHPALPLLVPHCPSETTNVGGYTIPKGSRVFVNVWAIHRDPSIWEKPLEFD

SEQ ID NO: 196 - DNA, 700 bp, Trifolium repens
  misc_feature (2)..(2): n is a, c, g, or t
  misc_feature (10)..(10): n is a, c, g, or t
  misc_feature (22)..(22): n is a, c, g, or t
  misc_feature (698)..(698): n is a, c, g, or t
gnaatccacnaatctcttgaantaataccatttctttacaagaacttaaccatggtgatgatcactcaataccaaaccttcctttacaaagaactttctatatcctttttcattttcttgataacccatttcatcataagttttctcttcaaaaaaaatctcaaaaaacttccaccaggcccaaaaggttttccagttgttggtgcactcccactaatgggatccatgcctcatgttaccctattcaaaatgtcacaaaaatatggtcccataatgtacctaaaaatgggatcaaataacatggttgtagcatcaactccttcttcagccaaagcatttctcaaaacacttgacctaaatttctccaatagaccgccgaacgctggcgcaactcacctagcttatgattcacaagacttggttttcgccgactatggatctaggtggaaattacttaggaaactaagtaacttgcacatgctcggcggaaaagccctcgaaaattggtcgaaagttcgtgagattgaaatgggtcacatgattcgtacaatgtacgattgtagcaagaaagacgaatccgttgttgtggccgaaatgttgacatatgctatggccaatatgataggtcaagttatattgagtcgtcgcgtgttcgagacaaaaggtagtgactcaaatgaatttaaggatatggttgntg

SEQ ID NO: 197 - protein, 216 aa, Trifolium repens
  misc_feature (216)..(216): Xaa can be any naturally occurring amino acid
MVMITQYQTFLYKELSISFFIFLITHFIISFLFKKNLKKLPPGPKGFPVVGALPLMGSMPHVTLFKMSQKYGPIMYLKMGSNNMVVASTPSSAKAFLKTLDLNFSNRPPNAGATHLAYDSQDLVFADYGSRWKLLRKLSNLHMLGGKALENWSKVREIEMGHMIRTMYDCSKKDESVVVAEMLTYAMANMIGQVILSRRVFETKGSDSNEFKDMVX

SEQ ID NO: 198 - DNA, 584 bp, Trifolium repens
  misc_feature (2)..(2): n is a, c, g, or t
  misc_feature (10)..(10): n is a, c, g, or t
  misc_feature (27)..(27): n is a, c, g, or t
gnaatccacnaatctcttgaattaatnccatttctttacaagaacttaaccatggtgatgatcactcaataccaaaccttccttttcaaagaactttctatctcctttttcattttcttgataacccgtttcatcataagttttctcttcaaaaaaaatctcaaaaaacttccaccaggcccaaagggttttccagttgttggtgcactcccactaatgggatccatgcctcatgttaccctattcaaaatgtcacaaaaatatggtcccataatgtacctaaaaatgggatcaaatagcatggttgtagcatcaactccttcttcagccaaagcatttctcaaaacacttgacctaaatttctccaatagaccgccgaacgctggcgcgactcacctagcttatgattcacaagacttggttttcgccgactatggatctaggtggaaattacttaggaaactaagtaacttgcacatgctcggcggaaaagccctcgaagattggtcgaaagttcgtgagattgaaatgggtcacatgattcgtacaatgtatgattgtagcaagaaagacgaatccgttgt

SEQ ID NO: 199 - DNA, 694 bp, Trifolium repens
  misc_feature (2)..(2): n is a, c, g, or t
  misc_feature (16)..(16): n is a, c, g, or t
  misc_feature (20)..(21): n is a, c, g, or t
  misc_feature (692)..(692): n is a, c, g, or t
gncaaatctcttgcantaannccatttctttacaagaacttaaccatggtgatgatcactcaacaccaaaccttcctttacaaagaactttctatatcctttttcattttcttgataacccatttcatcattagttttctcttcaaaaaaaatctcaaaaaacttccaccaggcccaaaaggttttccagttgttggtgcactcccactaatgggatccatgcctcatgttaccctattcaaaatgtcacaaaaatatggtcctataatgtacctaaaaatgggatcaaataacatggttgtagcatcaactccttcttcagccaaagcatttctcaaaacacttgacctaaatttctccaataggccggcgaacgctggcgcaactcacctagcttatgatccacaagacttggttttcgccgactatggatctaggtggaaattacttaggaaactaagtaacttgcacatgctcggcggaaaagcccttgaaaattggtcgaaagttcgtgagattgaaatgggtcacatgattcgtacaatgtacgattgtagcaagaaagacgaatccgttgttgtggccgaaatgttgacatatgctatggccaatatgataggtcaagttatattgagtcgtcgcgtgttcgagacaaaaggtagtgactcaaatgaatttaaggatatggttgntg

SEQ ID NO: 200 - DNA, 580 bp, Trifolium repens
  misc_feature (2)..(2): n is a, c, g, or t
  misc_feature (14)..(14): n is a, c, g, or t
  misc_feature (16)..(16): n is a, c, g, or t
  misc_feature (44)..(44): n is a, c, g, or t
  misc_feature (55)..(56): n is a, c, g, or t
cnaatctcttgaantnataccatttctttacaagaacttaaccntggtgatgatnnctcaataccaaaccttccttttcaaagaactttctatctcctttttcattttcttgataacccgtttcatcataagtcttctcttcaaaaaaaatctcaaaaaacttccaccaggcccaaagggttttccagttgttggtgcactcccactaatgggatccatgcctcatgttaccctattcaaaatgtcacaaaaatatggtcccataatgtacctaaaaatgggatcaaataacatggttgtagcatcaactccttcttcagccaaagcatttctcaaaacacttgacctaaatttctccaatagaccgccgaacgctggcgcgactcacctagcttatgattcacaagacttggttttcgccgactatggatctaggtggaaattgcttaggaaactaagtaacttgcacatgctcggcggaaaagccctcgaagattggtcgaaagttcgcgagattgagatgggtcacatgattcgtacaatgtacgattgtagcaagaaagacgaatatgttgttgtg

SEQ ID NO: 201 - DNA, 574 bp, Trifolium repens
  misc_feature (8)..(8): n is a, c, g, or t
  misc_feature (12)..(12): n is a, c, g, or t
  misc_feature (40)..(40): n is a, c, g, or t
  misc_feature (51)..(52): n is a, c, g, or t
  misc_feature (56)..(56): n is a, c, g, or t
  misc_feature (569)..(569): n is a, c, g, or t
  misc_feature (572)..(572): n is a, c, g, or t
tctcttgnaatnataccatttctttacaagaacttaaccntggtgatgatnnctcnataccaaaccttcctttacaaagaactttctatatcctttttcattttcttgataacccatttcatcattagttttctcttcaaaaaaaatctcaaaaaacttccaccaggcccaaaaggttttccagttgttggtgcactcccactaatgggatccatgcctcatgttaccctattcaaaatgtcacaaaaatatggtcctataatgtacctaaaaatgggatcaaataacatggttgtagcatcaactccttcttcagccaaagcatttctcaaaacacttgacctaaatttctccaataggccggcgaacgctggcgcaactcacctagcttatgattcacaagacttggttttcgccgactatggatctaggtggaaattacttaggaaactaagtaacttgcacatgctcggcggaaaagcccttgaaaattggtcgaaagttcgtgagattgaaatgggtcacatgattcgtacaatgtacgattgtagcaagaaagacgaatccgntgntg

SEQ ID NO: 202 - DNA, 1261 bp, Trifolium repens
  misc_feature (7)..(7): n is a, c, g, or t
  misc_feature (31)..(31): n is a, c, g, or t
  misc_feature (43)..(43): n is a, c, g, or t
  misc_feature (92)..(93): n is a, c, g, or t
  misc_feature (96)..(96): n is a, c, g, or t
  misc_feature (957)..(957): n is a, c, g, or t
gcacacntctatttatttctacttaaacctnacaaaaaataanacccacaaaacacaaacaccacaaacaccaaaaccgagtccgtttcctnntcnaacatggcaccaagccaaactctaagttatctctcacaacaaaacactcttgagtcaagtttcgttagggaagaagatgagcgtccaaaagttgcctacaataacttcagcaacgagattccaatcatttctcttgctggaattgatgaggttgatggtcgtagaacagagatatgtaacaagattgttgaagcttgtgagaattggggtatttttcaggttgttgatcatggtgttgatacaaaacttgtttctgagatgacccgttttgctagagagttttttgctttgccaccggaagagaagctccggtttgacatgtccggtggtaaaaagggtggtttcattgtctctagtcatctccaaggagaagcagtgaaggattggagagagctagtgacatatttttcatacccaattaaacaaagagattattcaaggtggccagacaagccagaaggatggaaagaggtaacagaaaaatacagtgaaaacctaatgaatttagcttgcaaactattggaagttttatcagaagcaatgggtttagaaaaagaagctctaacaaaagcatgtgttgatatggatcaaaaagttgttataaattattacccaaaatgccctgaacctgacctcacacttggccttaaacgtcacactgaccctggcacaattactcttttgcttcaagatcaagttggtggccttcaagctaccaaagataatggtaagacgtggattacagttcaaccagttgaaggtgcttttgttgttaatcttggagaccatggtcactatctaagtaatggacggttcaaaaatgctgaccaccaagcagtggtgaattcgaactacagccgnttatcaatagcaacatttcaaaatccagctcccgatgcaactgtataccctttgaagattagagagggtgaaaaatctgtgttggaagaaccaatcacttttgctgaaatgtatagaaggaagatgaccaaagaccttgaaattgctaggatgaagaagttggctaaggaacaacaacttagggacttggaggagaacaagactaaatatgaggccaaacctttgaatgagatctttgcttaattaattagtcttaatttaaataattaataaattttagacttaatttacatataataatttt

SEQ ID NO: 203 - protein, 366 aa, Trifolium repens
  misc_feature (286)..(286): Xaa can be any naturally occurring amino acid
MAPSQTLSYLSQQNTLESSFVREEDERPKVAYNNFSNEIPIISLAGIDEVDGRRTEICNKIVEACENWGIFQVVDHGVDTKLVSEMTRFAREFFALPPEEKLRFDMSGGKKGGFIVSSHLQGEAVKDWRELVTYFSYPIKQRDYSRWPDKPEGWKEVTEKYSENLMNLACKLLEVLSEAMGLEKEALTKACVDMDQKVVINYYPKCPEPDLTLGLKRHTDPGTITLLLQDQVGGLQATKDNGKTWITVQPVEGAFVVNLGDHGHYLSNGRFKNADHQAVVNSNYSXLSIATFQNPAPDATVYPLKIREGEKSVLEEPITFAEMYRRKMTKDLEIARMKKLAKEQQLRDLEENKTKYEAKPLNEIFA

SEQ ID NO: 204 - DNA, 586 bp, Trifolium repens
  misc_feature (7)..(7): n is a, c, g, or t
gcacacntctatttatttctacttaaacctcacaaaaaataaacccacaacacacaaacaccaaaaacagagcaccgtttccatcatcaaacatggcaccaagccaaactctaagttatctctcacaacaaaacactctcgagtcaagtttcgttagggaagaagatgagcgtccaaaagttgcctacaataacttcagcaacgagattccaatcatttctcttgctggaattgatgaggttgatggtcgtagaacagagatatgtaacaagattgttgaagcttgtgagaattggggtatttttcaggttgttgatcatggtgttgatacaaaacttgtttctgagatgacccgttttgctagagagttttttgctttgccaccggaagagaagctccggtttgacatgtccggtggtaaaaagggtggtttcattgtctctagtcatcttcaaggagaagcagtgaaggattggagagagctagtgacatatttttcatacccaattaaacaaagagattattcaaggtggccagacaagccagaaggatggaaagaggtaacagaaaaatacagtgaaaacct

SEQ ID NO: 205 - DNA, 597 bp, Trifolium repens
  misc_feature (5)..(5): n is a, c, g, or t
  misc_feature (7)..(7): n is a, c, g, or t
  misc_feature (31)..(31): n is a, c, g, or t
gcacngntctatttatttctacttaaacctnaaaaataaacccacaacacaaaccaaaaacagagcaccgtttccatcatcaaacatggcaccaagccaaaccctaagttatctctcacaacaaaagactcttgagtcaagtttcgttagggaagaagatgagcgtccaaaagttgcctacaataacttcagcaacgagattccaatcatttctcttgctggaattgatgaggttgatggtcgcagaacagagatatgtaacaagattgttgaagcttgtgagaattggggtatttttcaggttgttgatcatggtgttgatacaaagcttgtttctgagatgactcgttttgctagagagttttttgctttgccgccggaagagaagctccggtttgacatgtccggtggtaaaaagggtggtttcattgtctctagtcatctccaaggagaagcagtgaaagattggagagagctagtgacatatttttcatacccaattaaacaaagagattattcaaggtggccagacaagccagaagaatggaaagaagtaacagaaaaatacagtgaaaacctaatgaatttagcttgcag

SEQ ID NO: 206 - DNA, 605 bp, Trifolium repens
  misc_feature (6)..(6): n is a, c, g, or t
  misc_feature (30)..(30): n is a, c, g, or t
  misc_feature (42)..(42): n is a, c, g, or t
  misc_feature (71)..(71): n is a, c, g, or t
  misc_feature (90)..(92): n is a, c, g, or t
  misc_feature (94)..(95): n is a, c, g, or t
cacacntctatttatttctacttaaacctnacaaaaaataanacccacaacacacaaacaccaaaaacagnagcaccgtttccatcatcnnnannaacatggcaccaagccaaactctaagttatctctcacaacaaaacactctcgagtcaagtttcgttagggaagaagatgagcgtccaaaagttgcctacaataacttcagcaacgagattccaatcatttctcttgctggaattgatgaggttgatggtcgtagaacagagatatgtaacaagattgttgaagcttgtgagaattggggtatttttcaggttgttgatcatggtgttgatacaaaacttgtttctgagatgacccgttttgctagagagttttttgctttgccaccggaagagaagctccggtttgacatgtccggtggtaaaaagggtggtttcattgtctctagtcatcttcaaggagaagcagtgaaggattggagagagctagtgacatatttttcatacccaattaaacaaagagattattcaaggtggccagacaagccagaaggatggaaagaggtaacagaaaaatacagtgaaaacctaatgaatttagct

SEQ ID NO: 207 - DNA, 492 bp, Trifolium repens
  misc_feature (10)..(10): n is a, c, g, or t
  misc_feature (19)..(19): n is a, c, g, or t
  misc_feature (29)..(30): n is a, c, g, or t
  misc_feature (38)..(38): n is a, c, g, or t
  misc_feature (40)..(41): n is a, c, g, or t
  misc_feature (55)..(55): n is a, c, g, or t
  misc_feature (58)..(58): n is a, c, g, or t
  misc_feature (60)..(60): n is a, c, g, or t
  misc_feature (68)..(68): n is a, c, g, or t
  misc_feature (70)..(70): n is a, c, g, or t
  misc_feature (75)..(75): n is a, c, g, or t
  misc_feature (436)..(436): n is a, c, g, or t
  misc_feature (439)..(439): n is a, c, g, or t
  misc_feature (450)..(450): n is a, c, g, or t
  misc_feature (452)..(452): n is a, c, g, or t
  misc_feature (455)..(455): n is a, c, g, or t
  misc_feature (459)..(459): n is a, c, g, or t
  misc_feature (469)..(469): n is a, c, g, or t
  misc_feature (471)..(471): n is a, c, g, or t
  misc_feature (473)..(473): n is a, c, g, or t
  misc_feature (490)..(492): n is a, c, g, or t
tcccctctanttatttctncttaaacctnncaaaaatnannacccacaacacacnaanancaccaaananacagnagtaccgtttccatcatcaaacatggcaccaagccaaactctaagttatctctcacaacaaaacactctcgagtcaagtttcgttagggaagaagatgagcgtccaaaagttgcctacaataacttcagcaacgagattccaatcatttctcttgctggaattgatgaggttgatggtcgtagaacagagatatgtaacaagattgttgaagcttgtgagaattggggtatttttcaggttgttgatcatggtgttgatacaaaacttgtttctgagatgacccgttttgctagagagttttttgctttgccaccggaagagaagctccggtttgacatgtccggtggtaaaaagggtggnttnattgtctgtantngtntccnaggacaaccngngnaggattgcagagagctnnn

SEQ ID NO: 208 - DNA, 690 bp, Trifolium repens
  misc_feature (11)..(11): n is a, c, g, or t
  misc_feature (34)..(34): n is a, c, g, or t
  misc_feature (36)..(36): n is a, c, g, or t
  misc_feature (49)..(49): n is a, c, g, or t
gttaacacacnccaacacaaacaccaaaaacagnancaccgtttccatncatcaaacatggcaccaagccaaactctaagttatctctcacaacaaaacactctcgagtcaagtttcgttagggaagaagatgagcgtccaaaagttgcctacaataacttcagcaacgagattccaatcatttctcttgctggaattgatgaggttgatggtcgtagaacagagatatgtaacaagattgttgaagcttgtgagaattggggtatttttcaggttgttgatcatggtgttgatacaaaacttgtttctgagatgacccgttttgctagagagttttttgctttgccaccggaagagaagctccggtttgacatgtccggtggtaaaaagggtggtttcattgtctctagtcatctccaaggagaagcagtgaaggattggagagagctagtgacatatttttcatacccaattaaacaaagagattattcaaggtggccagacaagccagaaggatggaaagaggtaacagaaaaatacagtgaaaacctaatgaatttagcttgcaaactattggaagttttatcagaagcaatgggtttagaaaaagaagctctaacaaaagcatgtgttgatatggatcaaaaagttgttataaattattacccaaaatgccctgaacctgacctt

SEQ ID NO: 209 - DNA, 573 bp, Trifolium repens
  misc_feature (2)..(2): n is a, c, g, or t
  misc_feature (33)..(33): n is a, c, g, or t
  misc_feature (41)..(41): n is a, c, g, or t
  misc_feature (43)..(43): n is a, c, g, or t
gnaacccacaacacacaaacaccaaaacagagnccgtttcntnatcaaacatggcaccaagccaaactctaagttatctctcacaacaaaacactctcgagtcaagtttcgttagggaagaagatgagcgtccaaaagttgcctacaataacttcagcaacgagattccaatcatttctcttgctggaattgatgaggttgatggtcgtagaacagagatatgtaacaagattgttgaagcttgtgagaattggggtatttttcaggttgttgatcatggtgttgatacaaaacttgtttctgagatgacccgttttgctagagagttttttgctttgccaccggaagagaagctccggtttgacatgtccggtggtaaaaagggtggtttcattgtctctagtcatctccaaggagaagcagtgaaggattggagagagctagtgacatatttttcatacccaattaaacaaagagattattcaaggtggccagacaagccagaaggatggaaagaggtaacagaaaaatacagtgaaaacctaatgaatttagcttgcaagctattggaag

SEQ ID NO: 210 - DNA, 716 bp, Trifolium repens
  misc_feature (6)..(6): n is a, c, g, or t
  misc_feature (10)..(10): n is a, c, g, or t
  misc_feature (28)..(28): n is a, c, g, or t
  misc_feature (30)..(30): n is a, c, g, or t
  misc_feature (43)..(43): n is a, c, g, or t
  misc_feature (47)..(47): n is a, c, g, or t
  misc_feature (576)..(576): n is a, c, g, or t
  misc_feature (619)..(619): n is a, c, g, or t
  misc_feature (702)..(702): n is a, c, g, or t
  misc_feature (714)..(714): n is a, c, g, or t
cacacnaacnccaaacaccaaaaacagnancaccgtttccatncatncaaacatggcaccaagccaaactctaagttatctctcacaacaaaacactcttgagtcaagtttcgttagggaagaagatgagcgtccaaaagttgcctacaataacttcagcaacgagattccaatcatttctcttgctggaattgatgaggttgatggtcgtagaacagagatatgtaacaagattgttgaagcttgtgagaattggggtatttttcaggttgttgatcatggtgttgatacaaaacttgtttctgagatgacccgttttgctagagagttttttgctttgccaccggaagagaagctccggtttgacatgtccggtggtaaaaagggtggtttcattgtctctagtcatctccaaggagaagcagtgaaggattggagagagctagtgacatatttttcatacccaattaaacaaagagattattcaaggtggccagacaagccagaaggatggaaagaggtaacagaaaaatacagtgaaaacctaatgaatttagcttgcaaactattggaagntttatcagaagcaatgggtttagaaaaagaagctctaacaaangcatgtgttgatatggatcaaaaagttgttataaattattacccaaaatgccctgaacctgacctcccacttgccctaaacgncacactgacccnga

SEQ ID NO: 211 - DNA, 721 bp, Trifolium repens
  misc_feature (4)..(4): n is a, c, g, or t
  misc_feature (7)..(7): n is a, c, g, or t
  misc_feature (28)..(28): n is a, c, g, or t
  misc_feature (30)..(30): n is a, c, g, or t
  misc_feature (43)..(43): n is a, c, g, or t
  misc_feature (721)..(721): n is a, c, g, or t
cacnacnaccacaaacaccaaaaacagnancaccgtttccatncatcaaacatggcaccaagccaaactctaagttatctctcacaacaaaacactcttgagtcaagtttcgttagggaagaagatgagcgtccaaaagttgcctacaataacttcagcaacgagattccaatcatttctcttgctggaattgatgaggttgatggtcgtagaacagagatatgtaacaagattgttgaagcttgtgagaattggggtatttttcaggttgttgatcatggtgttgatacaaaacttgtttctgagatgacccgttttgctagagagttttttgctttgccaccggaagagaagctccggtttgacatgtccggtggtaaaaagggtggtttcattgtctctagtcatctccaaggagaagcagtgaaggattggagagagctagtgacatatttttcatacccaattaaacaaagagattattcaaggtggccagacaagccagaaggatggaaagaggtaacagaaaaatacagtgaaaacctaatgaatttagcttgcaaactattggaagttttatcagaagcaatgggtttagaaaaagaagctctaacaaaagcatgtgttgatatggatcaaaaagttgttataaattattacccaaaatgccctgaacctgacctcacacttggccttaaacgtcacactgaccctggcacan

SEQ ID NO: 212 - DNA, 453 bp, Trifolium repens
  misc_feature (6)..(6): n is a, c, g, or t
  misc_feature (79)..(79): n is a, c, g, or t
  misc_feature (173)..(173): n is a, c, g, or t
  misc_feature (215)..(215): n is a, c, g, or t
  misc_feature (220)..(220): n is a, c, g, or t
  misc_feature (235)..(235): n is a, c, g, or t
  misc_feature (245)..(245): n is a, c, g, or t
  misc_feature (257)..(257): n is a, c, g, or t
  misc_feature (283)..(284): n is a, c, g, or t
  misc_feature (303)..(303): n is a, c, g, or t
  misc_feature (307)..(307): n is a, c, g, or t
  misc_feature (311)..(311): n is a, c, g, or t
  misc_feature (317)..(317): n is a, c, g, or t
  misc_feature (322)..(322): n is a, c, g, or t
  misc_feature (336)..(336): n is a, c, g, or t
  misc_feature (346)..(346): n is a, c, g, or t
  misc_feature (361)..(361): n is a, c, g, or t
  misc_feature (366)..(367): n is a, c, g, or t
  misc_feature (375)..(375): n is a, c, g, or t
  misc_feature (393)..(393): n is a, c, g, or t
  misc_feature (397)..(397): n is a, c, g, or t
  misc_feature (399)..(399): n is a, c, g, or t
  misc_feature (401)..(401): n is a, c, g, or t
  misc_feature (407)..(407): n is a, c, g, or t
  misc_feature (411)..(411): n is a, c, g, or t
  misc_feature (422)..(422): n is a, c, g, or t
  misc_feature (425)..(425): n is a, c, g, or t
  misc_feature (430)..(432): n is a, c, g, or t
  misc_feature (437)..(437): n is a, c, g, or t
  misc_feature (445)..(445): n is a, c, g, or t
  misc_feature (447)..(448): n is a, c, g, or t
  misc_feature (450)..(453): n is a, c, g, or t
ccacancacacaaacaccaaaaacagaagcaccgtttccatcatcaaacatggcaccaagccaaactctaagttatctnggacaacaaaacactctcgagtcaagtttcgttagggaagaagatgaccgtccaaaagttgcctacaataccttcagcaccgagattccaatcntttctcttgctggaattgatgaggttgatggccgaaaaacanaaatntttaccaagattggnggggcttgtnaaaattggggtntttttcaggttggtgatcatggggtnnaacaaaacttgtttcccanaaancccnttttgntaaanagttttttgctttncccccggaanaaaacctccggtttnacttnnccgggggnaaaaaaggggggggtttnattngncnttaagncccnccccaaggganaancccannnaaggntttggaananncnnnn

SEQ ID NO: 213 - DNA, 267 bp, Trifolium repens
  misc_feature (4)..(4): n is a, c, g, or t
  misc_feature (10)..(10): n is a, c, g, or t
  misc_feature (15)..(15): n is a, c, g, or t
  misc_feature (23)..(23): n is a, c, g, or t
  misc_feature (30)..(30): n is a, c, g, or t
  misc_feature (45)..(46): n is a, c, g, or t
  misc_feature (48)..(49): n is a, c, g, or t
  misc_feature (208)..(208): n is a, c, g, or t
  misc_feature (210)..(210): n is a, c, g, or t
  misc_feature (215)..(215): n is a, c, g, or t
  misc_feature (226)..(227): n is a, c, g, or t
  misc_feature (231)..(231): n is a, c, g, or t
  misc_feature (245)..(245): n is a, c, g, or t
  misc_feature (250)..(250): n is a, c, g, or t
  misc_feature (253)..(253): n is a, c, g, or t
  misc_feature (260)..(260): n is a, c, g, or t
  misc_feature (265)..(265): n is a, c, g, or t
  misc_feature (267)..(267): n is a, c, g, or t
gaancccacnaacancaaacacncaaaaanagagaccgtttcctnntnnaacatggcaccaagccaaactctaagttatctctcacaacaaaacactcttgagtcaagtttcgttagggaagaagatgagcgtccaaaagttgcctacaataacttcagcaacgagattccaatcatttctcttgctggaattgatgaggttgatggncncacancacacatctgnnccanattgctggaacctngcganagncgccctncctcncn

SEQ ID NO: 214 - DNA, 580 bp, Trifolium repens
  misc_feature (2)..(2): n is a, c, g, or t
  misc_feature (38)..(38): n is a, c, g, or t
gnaccacacaaacacccaaaacagagcaccgtttcctnatcaacaatggcaccaagccaaactctaagttatctctcacaacaaaacactctcgagtcaagtttcgttagggaagaagatgagcgtccaaaagttgcctacaataacttcagcaacgagattccaatcatttctcttgctggaattgatgaggttgatggtcgtagaacagagatatgtaacaagattgttgaagcttgtgagaattggggtatttttcaggttgttgatcatggtgttgatacaaaacttgtttctgagatgacccgttttgctagagagttttttgctttgccaccggaagagaagctccggtttgacatgtccggtggtaaaaagggtggtttcattgtctctagtcatcttcaaggagaagcagtgaaggattggagagagctagtgacatatttttcatacccaattaaacaaagagattattcaaggtggccagacaagccagaaggatggaaagaggtaacagaaaaatacagtgaaaacctaatgaatttagcttgcaagctattggaagttttatcagaag

SEQ ID NO: 215 - DNA, 586 bp, Trifolium repens
  misc_feature (31)..(31): n is a, c, g, or t
  misc_feature (33)..(33): n is a, c, g, or t
  misc_feature (586)..(586): n is a, c, g, or t
ggcacacaaaccaaaacgagcccgtttcctntnaacatggcaccaagccaaaccctaagttatctctccaacaaaagactcttgagtcaagtttcgttagggaagaagatgagcgtccaaaagttgcctacaataacttcagcaacgagattccaatcatttctcttgctggaattgatgaggttgatggtcgcagaacagagatatgtaacaagattgttgaagcttgtgagaattggggtatttttcaggttgttgatcatggtgttgatacaaagcttgtttctgagatgactcgttttgctagagagttttttgctttgccgccggaagagaagctccggtttgacatgtccggtggtaaaaagggtggtttcattgtctctagtcatctccaaggagaagcagtgaaagattggagggagctagtgacatatttttcatacccaattaaacaaagagattattcaaggtggccagacaagccagaaggatggaaagaagtaacagaaaaatacagtgaaaacctaatgaatttagcttgcaagctattggaagttttatcagaagcaatgggattagaaan

SEQ ID NO: 216 - DNA, 450 bp, Trifolium repens
  misc_feature (26)..(26): n is a, c, g, or t
  misc_feature (37)..(37): n is a, c, g, or t
  misc_feature (96)..(96): n is a, c, g, or t
  misc_feature (363)..(363): n is a, c, g, or t
  misc_feature (390)..(390): n is a, c, g, or t
  misc_feature (403)..(403): n is a, c, g, or t
  misc_feature (410)..(410): n is a, c, g, or t
  misc_feature (416)..(417): n is a, c, g, or t
  misc_feature (421)..(421): n is a, c, g, or t
  misc_feature (436)..(436): n is a, c, g, or t
  misc_feature (438)..(438): n is a, c, g, or t
  misc_feature (450)..(450): n is a, c, g, or t
tctaacacaaacacccaaaacagagnaccgtttcctntccaacatggcaccaagccaaactctaagttatctctcaccacaaaacactcttgagtnaagtttcgttagggaagaagatgagcgtccaaaagttgcctacaataacttcagcaacgagattccaatcatttctcttgctggaattgatgaggttgatggtcgtagaacagagatatgtaacaagattgttgaagcttgtgagaattggggtatttttcaggttgttgatcatggtgttgatacaaaacttgtttctgagatgacccgttttgctagagagttttttgctttgccaccggaagagaagctccggtttgacatgtncggtggtaaaaagggtggtttcattgnctctagtcatctncaagganaagcanngaangattggagagagctngngacatatttttn

SEQ ID NO: 217 - DNA, 681 bp, Trifolium repens
  misc_feature (2)..(2): n is a, c, g, or t
  misc_feature (24)..(24): n is a, c, g, or t
  misc_feature (26)..(26): n is a, c, g, or t
  misc_feature (39)..(39): n is a, c, g, or t
  misc_feature (43)..(43): n is a, c, g, or t
  misc_feature (644)..(644): n is a, c, g, or t
cncaacacaaacaccaaaaacagnancaccgtttccatncatncaaacatggcaccaagccaaactctaagttatctctcacaacaaaacactcttgagtcaagtttcgttagggaagaagatgagcgtccaaaagttgcctacaataacttcagcaacgagattccaatcatttctcttgctggaattgatgaggttgatggtcgtagaacagagatatgtaacaagattgttgaagcttgtgagaattggggtatttttcaggttgttgatcatggtgttgatacaaaacttgtttctgagatgacccgttttgctagagagttttttgctttgccaccggaagagaagctccggtttgacatgtccggtggtaaaaagggtggtttcattgtctctagtcatctccaaggagaagcagtgaaggattggagagagctagtgacatatttttcatacccaattaaacaaagagattattcaaggtggccagacaagccagaaggatggaaagaggtaacagaaaaatacagtgaaaacctaatgaatttagcttgcaaactattggaagttttatcagaagcaatgggtttagaaaaagaagctctaacaaaagcatgtgttgatatggatcaaaaagttgntataaattattacccaaaatgccctgaacctgacctc

SEQ ID NO: 218 - DNA, 582 bp, Trifolium repens
  misc_feature (2)..(3): n is a, c, g, or t
  misc_feature (15)..(15): n is a, c, g, or t
  misc_feature (21)..(21): n is a, c, g, or t
  misc_feature (25)..(25): n is a, c, g, or t
  misc_feature (43)..(43): n is a, c, g, or t
  misc_feature (47)..(47): n is a, c, g, or t
gnnaatccacaacancaaacnccanaaacgagcccgtttcctnctcnaacatggcaccaagccaaactctaagttatctctcacaacaaaacactctcgagtcaagtttcgttagggaagaagatgagcgtccaaaagttgcctacaataacttcagcaacgagattccaatcatttctcttgctggaattgatgaggttgatggtcgaagaacagagatatgtaacaagattgttgaagcttgtgagaattggggtatttttcaggttgttgatcatggtgttgatacaaaacttgtttctgagatgacccgttttgctagagagttttttgctttgccaccggaagagaagctccggtttgacatgtccggtggtaaaaagggtggtttcattgtctctagtcatctccaaggagaagcagtgaaggattggagagagctagtgacatatttttcatacccaattaaacaaagagattattcaaggtggccagacaagccagaaggatggaaagaggtaacagaaaaatacagtgaaaacctaatgaatttagcttgcaaactattggaagttttatcag

SEQ ID NO: 219 - DNA, 610 bp, Trifolium repens
  misc_feature (31)..(31): n is a, c, g, or t
  misc_feature (41)..(41): n is a, c, g, or t
gaaccccacaacacccaaacccaaaacgagnccgtttcctntcaacatggcaccaagccaaactctaagttatctctcacaacaaaacactctcgagtcaagtttcgttagggaagaagatgagcgtccaaaagttgcctacaataacttcagcaacgagattccaatcatttctcttgctggaattgatgaggttgatggtcgtagaacagagatatgtaacaagattgttgaagcttgtgagaattggggtatttttcaggttgttgatcatggtgttgatacaaaacttgtttctgagatgacccgttttgctagagagttttttgctttgccaccggaagagaagctccggtttgacatgtccggtggtaaaaagggtggtttcattgtctctagtcatctccaaggagaagcagtgaaggattggagagagctagtgacatatttttcatacccaattaaacaaagagattattcaaggtggccagacaagccagaaggatggaaagaggtaacagaaaaatacagtgaaaacctaatgaatttagcttgcaagctattggaagttttatcagaagcaatgggtttagaaaaagaagctctaaca

SEQ ID NO: 220 - DNA, 593 bp, Trifolium repens
  misc_feature (16)..(16): n is a, c, g, or t
  misc_feature (23)..(23): n is a, c, g, or t
  misc_feature (41)..(42): n is a, c, g, or t
  misc_feature (45)..(45): n is a, c, g, or t
  misc_feature (593)..(593): n is a, c, g, or t
aaccccacgacaccanaacccanaaacgagcccgtttcctnntcnaacatggcaccaagccaaactctaagttatctctcacaacaaaacactctcgagtcaagtttcgttagggaagaagatgagcgtccaaaagttgcctacaataacttcagcaacgagattccaatcatttctcttgctggaattgatgaggttgatggtcgtagaacagagatatgtaacaagattgttgaagcttgtgagaattggggtatttttcaggttgttgatcatggtgttgatacaaaacttgtttctgagatgacccgttttgctagagagttttttgctttgccaccggaagagaagctccggtttgacatgtccggtggtaaaaagggtggtttcattgtctctagtcatcttcaaggagaagcagtgaaggattggagagagctagtgacatatttttcatacccaattaaacaaagagattattcaaggtggccagacaagccagaaggatggaaagaggtaacagaaaaatacagtgaaaacctaatgaatttagcttgcaagctattggaagttttatcagaagcaatgggttn

SEQ ID NO: 221 - DNA, 236 bp, Trifolium repens
  misc_feature (5)..(5): n is a, c, g, or t
  misc_feature (10)..(10): n is a, c, g, or t
  misc_feature (18)..(18): n is a, c, g, or t
  misc_feature (26)..(26): n is a, c, g, or t
  misc_feature (41)..(41): n is a, c, g, or t
  misc_feature (43)..(43): n is a, c, g, or t
  misc_feature (203)..(206): n is a, c, g, or t
  misc_feature (209)..(209): n is a, c, g, or t
  misc_feature (213)..(213): n is a, c, g, or t
  misc_feature (216)..(217): n is a, c, g, or t
  misc_feature (224)..(225): n is a, c, g, or t
  misc_feature (234)..(236): n is a, c, g, or t
gcacnaacancacaaacncccaaaangagaccgtttcctcntnaaacatggcaccaagccaaactctaagttatctctcacaacaaaacactctcgagtcaagtttcgttagggaagaagatgagcgtccaaaagttgcctacaataacttcagcaacgagattccaatcatttctcttgctggaattgatgaggttgatggnnnnggnaccnggnnatgtggnnagaggacgnnn

SEQ ID NO: 222 - DNA, 273 bp, Trifolium repens
  misc_feature (4)..(4): n is a, c, g, or t
  misc_feature (9)..(10): n is a, c, g, or t
  misc_feature (13)..(13): n is a, c, g, or t
  misc_feature (34)..(34): n is a, c, g, or t
  misc_feature (36)..(36): n is a, c, g, or t
  misc_feature (151)..(151): n is a, c, g, or t
  misc_feature (198)..(198): n is a, c, g, or t
  misc_feature (205)..(205): n is a, c, g, or t
  misc_feature (255)..(255): n is a, c, g, or t
  misc_feature (270)..(270): n is a, c, g, or t
  misc_feature (273)..(273): n is a, c, g, or t
acancaccnnacnccaaaacgagtccgttccctntnaacatggcaccaagccaaactctaagttatctctcacaacaaaacactctcgagtcaagtttcgttagggaagaagatgagcgtccaaaagttgcctacaataacttcagcaacnagattccaatcatttctcttgctggaattgatgaggttgatggtcgnagaacanagatatgtaacaagattgttgaagcttgtgagaattggggtatttttcangttgttgatcatggngtn

SEQ ID NO: 223 - DNA, 572 bp, Trifolium repens
  misc_feature (3)..(4): n is a, c, g, or t
  misc_feature (8)..(8): n is a, c, g, or t
  misc_feature (16)..(16): n is a, c, g, or t
  misc_feature (18)..(18): n is a, c, g, or t
  misc_feature (39)..(39): n is a, c, g, or t
  misc_feature (41)..(42): n is a, c, g, or t
gcnncaancacaaacncnaaaacgagcaccgtttcctantnnaacatggcaccaagccaaactctaagttatctctcacaacaaaaaaccgtcgagtcaagtttcgttagggaagaagatgagcgtccaaaagttgcctacaataacttcagcaacgagattccaatcatttctcttgctggaattgatgaggttgatggtcgcagaacagagatatgtaacaagattgttgaagcttgtgagaattggggtatttttcaggttgttgatcatggtgttgatacaaagcttgtttctgagatgactcgttttgctagagagttttttgctttgccgccggaagagaagctccggtttgacatgtccggtggtaaaaagggtggtttcattgtctctagtcatctccaaggagaagcagtgaaagattggagagagctagtgacatatttttcatacccaattaaacaaagagattattcaaggtggccagacaagccagaaggatggaaagaagtaacagaaaaatacagtgaaaacctaatgaatttagcttgcaagctattggaagtttt

SEQ ID NO: 224 - DNA, 575 bp, Trifolium repens
  misc_feature (2)..(2): n is a, c, g, or t
  misc_feature (10)..(10): n is a, c, g, or t
  misc_feature (12)..(12): n is a, c, g, or t
  misc_feature (16)..(16): n is a, c, g, or t
  misc_feature (20)..(20): n is a, c, g, or t
  misc_feature (38)..(38): n is a, c, g, or t
  misc_feature (41)..(42): n is a, c, g, or t
  misc_feature (54)..(54): n is a, c, g, or t
  misc_feature (77)..(78): n is a, c, g, or t
  misc_feature (99)..(99): n is a, c, g, or t
gnacccacancnaacnccanaaacgagcccgtttcctnctnnaacatggcaccnagccaaactctaagttatctctnncaacaaaacactcttgagtcnagtttcgttagggaagaagatgagcgtccaaaagttgcctacaataacttcagcaacgagattccaatcatttctcttgctggaattgatgaggttgatggtcgtagaacagagatatgtaacaagattgttgaagcttgtgagaattggggtatttttcaggttgttgatcatggtgttgatacaaaacttgtttctgagatgacccgttttgctagagagttttttgctttgccaccggaagagaagctccggtttgacatgtccggtggtaaaaagggtggtttcattgtctctagtcatctccaaggagaagcagtgaaggattggagagagctagtgacatatttttcatacccaattaaacaaagagattattcaaggtggccagacaagccagaaggatggaaagaggtaacagaaaaatacagtgaaaacctaatgaatttagcttgcaaactattggaagttttatc

SEQ ID NO: 225 - DNA, 596 bp, Trifolium repens
  misc_feature (10)..(11): n is a, c, g, or t
  misc_feature (15)..(15): n is a, c, g, or t
  misc_feature (26)..(26): n is a, c, g, or t
ccacaacacnnaacnccaaaacgagnccgtttcctctcaacatggcaccaagccaaactctaagttatctctcacaacaaaacactctcgagtcaagtttcgttagggaagaagatgagcgtccaaaagttgcctacaataacttcagcaacgagattccaatcatttctcttgctggaattgatgaggttgatggtcgtagaacagagatatgtaacaagattgttgaagcttgtgagaattggggtatttttcaggttgttgatcatggtgttgatacaaaacttgtttctgagatgacccgttttgctagagagttttttgctttgccaccggaagagaagctccggtttgacatgtccggtggtaaaaagggtggtttcattgtctctagtcatctccaaggagaagcagtgaaggattggagagagctagtgacatatttttcatacccaattaaacaaagagattattcaaggtggccagacaagccagaaggatggaaagaggtaacagaaaaatacagtgaaaacctaatgaatttagcttgcaaactattggaagttttatcagaagcaatgggtttagaaaaagag

SEQ ID NO: 226 - DNA, 612 bp, Trifolium repens
  misc_feature (9)..(9): n is a, c, g, or t
  misc_feature (13)..(13): n is a, c, g, or t
  misc_feature (36)..(36): n is a, c, g, or t
cacaacacncacnccaaaacgagcccgtttcctctnaacatggcaccaagccaaactctaagttatctctccaacaaaacactcttgagtcaagtttcgttagggaagaagatgagcgtccaaaagttgcctacaataacttcagcaacgagattccaatcatttctcttgctggaattgatgaggttgatggtcgtagaacagagatatgtaacaagattgttgaagcttgtgagaattggggtatttttcaggttgttgatcatggtgttgatacaaaacttgtttctgagatgacccgttttgctagagagttttttgctttgccaccggaagagaagctccggtttgacatgtccggtggtaaaaagggtggtttcattgtctctagtcatctccaaggagaagcagtgaaggattggagagagctagtgacatatttttcatacccaattaaacaaagagattattcaaggtggccagacaagccagaaggatggaaagaggtaacagaaaaatacagtgaaaacctaatgaatttagcttgcaaactattggaagttttatcagaagcaatgggtttagaaaaagaagctctaacaaaagcatgtg

SEQ ID NO: 227 - DNA, 535 bp, Trifolium repens
  misc_feature (32)..(32): n is a, c, g, or t
  misc_feature (69)..(69): n is a, c, g, or t
acaacacaaacccaaaacgagcccgtttcctntcaacatggcaccaagccaaactctaagttatctctncaacaaaacactcttgagtcaagtttcgttagggaagaagatgagcgtccaaaagttgcctacaataacttcagcaacgagattccaatcatttctcttgctggaattgatgaggttgatggtcgtagaacagagatatgtaacaagattgttgaagcttgtgagaattggggtatttttcaggttgttgatcatggtgttgatacaaaacttgtttctgagatgacccgttttgctagagagttttttgctttgccaccggaagagaagctccggtttgacatgtccggtggtaaaaagggtggtttcattgtctctagtcatctccaaggagaagcagtgaaggattggagagagctagtgacatatttttcatacccaattaaacaaagagattattcaaggtggccagacaagccagaaggatggaaagaggtaacagaaaaatacagtgaaaacctaatgc

SEQ ID NO: 228 - DNA, 559 bp, Trifolium repens
  misc_feature (23)..(23): n is a, c, g, or t
  misc_feature (33)..(33): n is a, c, g, or t
  misc_feature (559)..(559): n is a, c, g, or t
gcaacacaaacaccaaaacgagnccgtttcctntcaacatggcaccaagccaaactctaagttatctctcccacaaaacactcttgagtcaagtttcgttagggaagaagatgagcgtccaaaagttgcctacaataacttcagcaacgagattccaatcatttctcttgctggaattgatgaggttgatggtcgtagaacagagatatgtaacaagattgttgaagcttgtgagaattggggtatttttcaggttgttgatcatggtgttgatacaaaacttgtttctgagatgacccgttttgctagagagttttttgctttgccaccggaagagaagctccggtttgacatgtccggtggtaaaaagggtggtttcattgtctctagtcatctccaaggagaagcagtgaaggattggagagagctagtgacatatttttcatacccaattaaacaaagagattattcaaggtggccagacaagccagaaggatggaaagaggtaacagaaaaatacagtgaaaacctaatgaatttagcttgcaaactattggan

SEQ ID NO: 229 - DNA, 565 bp, Trifolium repens
  misc_feature (3)..(3): n is a, c, g, or t
gcncaacacaaaccaaaacgagcccgtttcctatcaacatggcaccaagccaaaccctaagttatctctcacaacaaaagactcttgagtcaagtttcgttagggaagaagatgagcgtccaaaagttgcctacaataacttcagcaacgagattccaatcatttctcttgctggaattgatgaggttgatggtcgcagaacagagatatgtaacaagattgttgaagcttgtgagaattggggtatttttcaggttgttgatcatggtgttgatacaaagcttgtttctgagatgactcgttttgctagagagttttttgctttgccgccggaagagaagctccggtttgacatgtccggtggtaaaaagggtggtttcattgtctctagtcatctccaaggagaagcagtgaaagattggagagagctagtgacatatttttcatacccaattaaacaaagagattattcaaggtggccagacaagccagaaggatggaaagaagtaacagaaaaatacagtgaaaacctaatgaatttagcttgcaagctattggaagtttt

SEQ ID NO: 230 - DNA, 591 bp, Trifolium repens
  misc_feature (6)..(6): n is a, c, g, or t
  misc_feature (12)..(12): n is a, c, g, or t
  misc_feature (16)..(16): n is a, c, g, or t
  misc_feature (32)..(32): n is a, c, g, or t
  misc_feature (34)..(34): n is a, c, g, or t
  misc_feature (38)..(38): n is a, c, g, or t
  misc_feature (74)..(74): n is a, c, g, or t
  misc_feature (591)..(591): n is a, c, g, or t
caacancaaacnccanaaacgagcccgtttcntnctcnaacatggcaccaagccaaactctaagttatctctcncaacaaaacactctcgagtcaagtttcgttagggaagaagatgagcgtccaaaagttgcctacaataacttcagcaacgagattccaatcatttctcttgctggaattgatgaggttgatggtcgaagaacagagatatgtaacaagattgttgaagcttgtgagaattggggtatttttcaggttgttgatcatggtgttgatacaaaacttgtttctgagatgacccgttttgctagagagttttttgctttgccaccggaagagaagctccggtttgacatgtccggtggtaaaaagggtggtttcattgtctctagtcatctccaaggagaagcagtgaaggattggagagagctagtgacatatttttcatacccaattaaacaaagagattattcaaggtggccagacaagccagaaggatggaaagaggtaacagaaaaatacagtgaaaacctaatgaatttagcttgcaaactattggaagttttatcagaagcaatgggtttagaan

SEQ ID NO: 231 - DNA, 609 bp, Trifolium repens
  misc_feature (14)..(14): n is a, c, g, or t
  misc_feature (66)..(66): n is a, c, g, or t
  misc_feature (76)..(76): n is a, c, g, or t
  misc_feature (84)..(84): n is a, c, g, or t
  misc_feature (94)..(95): n is a, c, g, or t
  misc_feature (98)..(98): n is a, c, g, or t
gcagttatctctcncaacaaaacactctcgagtcaagtttcgttagggaagaagatgagcgtacancaaacaccanaaacgagnccgtttcctnntcnaacatggcaccaagccaaactctaccaaaagttgcctacaataacttcagcaacgagattccaatcatttctcttgctggaattgatgaggttgatggtcgtagaacagagatatgtaacaagattgttgaagcttgtgagaattggggtatttttcaggttgttgatcatggtgttgatacaaaacttgtttctgagatgacccgttttgctagagagttttttgctttgccaccggaagagaagctccggtttgacatgtccggtggtaaaaagggtggtttcattgtctctagtcatcttcaaggagaagcagtgaaggattggagagagctagtgacatatttttcatacccaattaaacaaagagattattcaaggtggccagacaagccagaaggatggaaagaggtaacagaaaaatacagtgaaaacctaatgaatttagcttgcaagctattggaagttttatcagaagcaatgggtttagaaaaagaagctctaacaaaag

SEQ ID NO: 232 - DNA, 597 bp, Trifolium repens
  misc_feature (11)..(11): n is a, c, g, or t
  misc_feature (15)..(16): n is a, c, g, or t
  misc_feature (24)..(24): n is a, c, g, or t
  misc_feature (26)..(27): n is a, c, g, or t
  misc_feature (29)..(29): n is a, c, g, or t
aacccaaaacngagnnccgtttcntnntnaacatggcccagccaaactctaagttatctctccaacaaaacactctcgagtcaagtttcgttagggaagaagatgagcgtccaaaagttgcctacaataacttcagcaacgagattccaatcatttctcttgctggaattgatgaggttgatggtcgtagaacagagatatgtaacaagattgttgaagcttgtgagaattggggtatttttcaggttgttgatcatggtgttgatacaaaacttgtttctgagatgacccgttttgctagagagttttttgctttgccaccggaagagaagctccggtttgacatgtccggtggtaaaaagggtggtttcattgtctctagtcatctccaaggagaagcagtgaaggattggagagagctagtgacatatttttcatacccaattaaacaaagagattattcaaggtggccagacaagccagaaggatggaaagaggtaacagaaaaatacagtgaaaacctaatgaatttagcttgcaagctattggaagttttatcagaagcaatgggtttagaaaaagaagctctaacaaaag

SEQ ID NO: 233 - DNA, 418 bp, Trifolium repens
  misc_feature (10)..(10): n is a, c, g, or t
  misc_feature (25)..(25): n is a, c, g, or t
  misc_feature (29)..(29): n is a, c, g, or t
  misc_feature (31)..(31): n is a, c, g, or t
  misc_feature (354)..(354): n is a, c, g, or t
  misc_feature (361)..(361): n is a, c, g, or t
  misc_feature (369)..(369): n is a, c, g, or t
  misc_feature (378)..(378): n is a, c, g, or t
  misc_feature (387)..(387): n is a, c, g, or t
  misc_feature (410)..(410): n is a, c, g, or t
  misc_feature (412)..(412): n is a, c, g, or t
  misc_feature (415)..(415): n is a, c, g, or t
  misc_feature (418)..(418): n is a, c, g, or t
accccacctnaaaccgagaccgttncctntnaacatggcaccaagccaaactctaagttatctctcacaacaaaacactcttgagtcaagtttcgttagggaagaagatgagcgtccaaaagttgcctacaataacttcagcaacgagattccaatcatttctcttgctggaattgatgaggttgatggtcgtagaacagagatatgtaacaagattgttgaagcttgtgagaattggggtatttttcaggttgttgatcatggtgttgatacaaaacttgtttctgagatgacccgttttgctagagagttttttgctttgccaccggaagagaagctccggtttgacatgtncggtggnaaaaaggntggctccantgcctgtanccatctccaaggagaaccacccnangantgn

SEQ ID NO: 234 - DNA, 570 bp, Trifolium repens
  misc_feature (3)..(4): n is a, c, g, or t
  misc_feature (13)..(13): n is a, c, g, or t
  misc_feature (31)..(32): n is a, c, g, or t
gcnnaaacaccanaaacgagcccgtttcctnntcgaacatggcaccaagccaaactctaagttatctctcacaacaaaacactcttgagtcaagtttcgttagggaagaagatgagcgtccaaaagttgcctacaataacttcagcaacgagattccaatcatttctcttgctggaattgatgaggttgatggtcgtagaacagagatatgtaacaagattgttgaagcttgtgagaattggggtatttttcaggttgttgatcatggtgttgatacaaaacttgtttctgagatgacccgttttgctagagagttttttgctttgccaccggaagagaagctccggtttgacatgtccggtggtaaaaagggtggtttcattgtctctagtcatctccaaggagaagcagtgaaggattggagagagctagtgacatatttttcatacccaattaaacaaagagattattcaaggtggccagacaagccagaaggatggaaagaggtaacagaaaaatacagtgaaaacctaatgaatttagcttgcaaactattggaagttttatcag

SEQ ID NO: 235 - DNA, 608 bp, Trifolium repens
  misc_feature (30)..(30): n is a, c, g, or t
caacaccacccaaaacgagcccgtttcctntcaacatggcaccaagccaaactctaagttatctctcacaacaaaacactcttgagtcaagtttcgttagggaagaagatgagcgtccaaaagttgcctacaataacttcagcaacgagattccaatcatttctcttgctggaattgatgaggttgatggtcgtagaacagagatatgtaacaagattgttgaagcttgtgagaattggggtatttttcaggttgttgatcatggtgttgatacaaaacttgtttctgagatgacccgttttgctagagagttttttgctttgccaccggaagagaagctccggtttgacatgtccggtggtaaaaagggtggtttcattgtctctagtcatctccaaggagaagcagtgaaggattggagagagctagtgacatatttttcatacccaattaaataaagagattattcaaggtggccagacaagccagaaggatggaaagaggtaacagaaaaatacagtgaaaacctaatgaatttagcttgcaaactattggaagttttatcagaagcaatgggtttagaaaaagaagctctaacaaaagcatgt

SEQ ID NO: 236 - DNA, 602 bp, Trifolium repens
  misc_feature (12)..(12): n is a, c, g, or t
  misc_feature (16)..(16): n is a, c, g, or t
  misc_feature (28)..(28): n is a, c, g, or t
  misc_feature (506)..(506): n is a, c, g, or t
  misc_feature (536)..(536): n is a, c, g, or t
  misc_feature (569)..(569): n is a, c, g, or t
  misc_feature (597)..(597): n is a, c, g, or t
  misc_feature (599)..(599): n is a, c, g, or t
  misc_feature (601)..(601): n is a, c, g, or t
caaaccaaaacngagnccgtttcctatnaacatggcaccaagccaaactctaagttatctctcacaacaaaaaaccgtcgagtcaagtttcgttagggaagaagatgagcgtccaaaagttgcctacaataacttcagcaacgagattccaatcatttctcttgctggaattgatgaggttgatggtcgcagaacagagatatgtaacaagattgttgaagcttgtgagaattggggtatttttcaggttgttgatcatggtgttgatacaaagcttgtttctgagatgactcgttttgctagagagttttttgctttgccgccggaagagaagctccggtttgacatgtccggtggtaaaaagggtggtttcattgtctctagtcgtctccaaggagaagcagtgaaagattggagagagctagtgacatatttttcatacccaattaaacaaagagattattcaaggtggccagacaagccagaaggatggaaagaagtaacanaaaaatacagtgaaaacctaatgaatttancttgcaagctattggaagttttatcacaagcantgggattacaaaaagaagctgttacaanancnt

SEQ ID NO: 237 - DNA, 536 bp, Trifolium repens
  misc_feature (1)..(1): n is a, c, g, or t
  misc_feature (14)..(14): n is a, c, g, or t
  misc_feature (22)..(22): n is a, c, g, or t
  misc_feature (24)..(24): n is a, c, g, or t
  misc_feature (155)..(155): n is a, c, g, or t
  misc_feature (271)..(271): n is a, c, g, or t
  misc_feature (314)..(314): n is a, c, g, or t
  misc_feature (388)..(388): n is a, c, g, or t
  misc_feature (395)..(395): n is a, c, g, or t
  misc_feature (401)..(401): n is a, c, g, or t
  misc_feature (499)..(499): n is a, c, g, or t
  misc_feature (533)..(533): n is a, c, g, or t
  misc_feature (536)..(536): n is a, c, g, or t
nacccaaaacgagnccgtttcntnctcaacatggctcctagccaaactctaagttatctctcccacaaaacactcttgagtcagtttcgttagggaagaagatgagcgtccaaaagttgcctacaataacttcagcaacgagattccaatcattnctcttgctggaattgatgaggttgatggtcgcagaacagagatatgtaacaagattgttgaagcttgtgagaattggggtatttttcaggttgttgatcatggtgttgatacaaancttgtttctgagatgacccgttttgctagagagttttttgctntgccaccggaagagaagctccggtttgacatgtccggtggtaaaaagggtggtttcattgtctctagtcatctncaagganaagcantgaaggattggagagagctagtgacatatttttcatacccaattaaacaaagagattattcaaggtggccagacaagccagaaggatggaaagaggtnacagaaaaatacagcgaaaacctaatgaatttanctn

SEQ ID NO: 238 - DNA, 572 bp, Trifolium repens
  misc_feature (12)..(12): n is a, c, g, or t
  misc_feature (21)..(21): n is a, c, g, or t
  misc_feature (25)..(26): n is a, c, g, or t
  misc_feature (28)..(28): n is a, c, g, or t
  misc_feature (30)..(30): n is a, c, g, or t
  misc_feature (39)..(39): n is a, c, g, or t
  misc_feature (87)..(87): n is a, c, g, or t
caaaccaaaacngagcccgtnttcnntntnaacatggcnaccagccaaaccctaagttatctctcacaacaaaagactcttgagtcnagtttcgttagggaagaagatgagcgtccaaaagttgcctacaataacttcagcaacgagattccaatcatttctcttgctggaattgatgaggttgatggtcgcagaacagagatatgtaacaagattgttgaagcttgtgagaattggggtatttttcaggttgttgatcatggtgttgatacaaagcttgtttctgagatgactcgttttgctagagagttttttgctttgccgccggaagagaagctccggtttgacatgtccggtggtaaaaagggtggtttcattgtctctagtcatctccaaggagaagcagtgaaagattggagggagctagtgacatatttttcatacccaattaaacaaagagattattcaaggtggccagacaagccagaaggatggaaagaagtaacagaaaaatacagtgaaaacctaatgaatttagcttgcaagctattggaagttttatcagaagcaat

SEQ ID NO: 239 - DNA, 573 bp, Trifolium repens
  misc_feature (7)..(7): n is a, c, g, or t
  misc_feature (15)..(15): n is a, c, g, or t
  misc_feature (23)..(23): n is a, c, g, or t
  misc_feature (25)..(26): n is a, c, g, or t
  misc_feature (28)..(29): n is a, c, g, or t
  misc_feature (38)..(38): n is a, c, g, or t
  misc_feature (41)..(41): n is a, c, g, or t
  misc_feature (65)..(65): n is a, c, g, or t
aacaccnacacgagnccgtttcntnntnnaacatggcnccnagccaaactctaagttatctctcncaacaaaacactctcgagtcaagtttcgttagggaagaagatgagcgtccaaaagttgcctacaataacttcagcaacgagattccaatcatttctcttgctggaattgatgaggttgatggtcgaagaacagagatatgtaacaagattgttgaagcttgtgagaattggggtatttttcaggttgttgatcatggtgttgatacaaaacttgtttctgagatgacccgttttgctagagagttttttgctttgccaccggaagagaagctccggtttgacatgtccggtggtaaaaagggtggtttcattgtctctagtcatctccaaggagaagcagtgaaggattggagagagctagtgacatatttttcatacccaattaaacaaagagattattcaaggtggccagacaagccagaaggatggaaagaggtaacagaaaaatacagtgaaaacctaatgaatttagcttgcaaactattggaagttttatcagaagcaatgg

SEQ ID NO: 240 - DNA, 573 bp, Trifolium repens
  misc_feature (8)..(8): n is a, c, g, or t
  misc_feature (14)..(14): n is a, c, g, or t
  misc_feature (23)..(24): n is a, c, g, or t
  misc_feature (26)..(26): n is a, c, g, or t
  misc_feature (28)..(28): n is a, c, g, or t
  misc_feature (37)..(37): n is a, c, g, or t
aaccaaanccgagnccgtttccnntntnaacatggcnccaagccaaaccctaagttatctctcacaacaaaagactcttgagtcaagtttcgttagggaagaagatgagcgtccaaaagttgcctacaataacttcagcaacgagattccaatcatttctcttgctggaattgatgaggttgatggtcgcagaacagagatatgtaacaagattgttgaagcttgtgagaattggggtatttttcaggttgttgatcatggtgttgatacaaagcttgtttctgagatgactcgttttgctagagagttttttgctttgccgccggaagagaagctccggtttgacatgtccggtggtaaaaagggtggtttcattgtctctagtcatctccaaggagaagcagtgaaagattggagggagctagtgacatatttttcatacccaattaaacaaagagattattcaaggtggccagacaagccagaaggatggaaagaagtaacagaaaaatacagtgaaaacctaatgaatttagcttgcaagctattggaagttttatcagaagcaatggg

SEQ ID NO: 241 - DNA, 584 bp, Trifolium repens
  misc_feature (9)..(9): n is a, c, g, or t
  misc_feature (14)..(14): n is a, c, g, or t
  misc_feature (19)..(19): n is a, c, g, or t
  misc_feature (23)..(24): n is a, c, g, or t
  misc_feature (28)..(28): n is a, c, g, or t
  misc_feature (37)..(37): n is a, c, g, or t
  misc_feature (40)..(40): n is a, c, g, or t
aaccaaaancgagnccgtnttcnntatnaacatggcnccnagccaaaccctaagttatctctcacaacaaaagactcttgagtcaagtttcgttagggaagaagatgagcgtccaaaagttgcctacaataacttcagcaacgagattccaatcatttctcttgctggaattgatgaggttgatggtcgcagaacagagatatgtaacaagattgttgaagcttgtgagaattggggtatttttcaggttgttgatcatggtgttgatacaaagcttgtttctgagatgactcgttttgctagagagttttttgctttgccgccggaagagaagctccggtttgacatgtccggtggtaaaaagggtggtttcattgtctctagtcatctccaaggagaagcagtgaaagattggagagagctagtgacatatttttcatacccaattaaacaaagagattattcaaggtggccagacaagccagaaggatggaaagaagtaacagaaaaatacagtgaaaacctaatgaatttagcttgcaagctattggaagttttatcagaagcaatgggattagaaaaag

SEQ ID NO: 242 - DNA, 529 bp, Trifolium repens
  misc_feature (2)..(2): n is a, c, g, or t
  misc_feature (6)..(6): n is a, c, g, or t
  misc_feature (8)..(8): n is a, c, g, or t
  misc_feature (12)..(15): n is a, c, g, or t
  misc_feature (18)..(18): n is a, c, g, or t
  misc_feature (23)..(23): n is a, c, g, or t
  misc_feature (27)..(27): n is a, c, g, or t
  misc_feature (33)..(33): n is a, c, g, or t
  misc_feature (35)..(35): n is a, c, g, or t
  misc_feature (49)..(49): n is a, c, g, or t
  misc_feature (103)..(103): n is a, c, g, or t
  misc_feature (332)..(333): n is a, c, g, or t
  misc_feature (354)..(354): n is a, c, g, or t
  misc_feature (368)..(368): n is a, c, g, or t
  misc_feature (385)..(385): n is a, c, g, or t
  misc_feature (413)..(413): n is a, c, g, or t
  misc_feature (425)..(425): n is a, c, g, or t
  misc_feature (428)..(428): n is a, c, g, or t
  misc_feature (488)..(488): n is a, c, g, or t
  misc_feature (515)..(515): n is a, c, g, or t
  misc_feature (517)..(517): n is a, c, g, or t
  misc_feature (522)..(522): n is a, c, g, or t
tngatntntctnnnnacnaaagnctcntcagtnangtttcgttgggaangaagatgagcgtccaaaagttgcctacaataacttcagcaacgagattccaatnatttctcttgctggaattgatgaggttgatggtcgcagaacagagatatgtaacaagattgttgaagcttgtgagaattggggtatttttcaggttgctgatcatggtgttgatacaaagcttgtttctgagatgactcgttttgctagagagttttttgctttgccgccggaagagaagctccggtttgacatgtccggtggtaaaaagggtggtttcattgtctctnntcatctccaaggagaagcagngaaagattggaganagctagtgacatatttntcatacccaattaaacaaagagattatncaaggtggtcanacnagccagaaggatggaaagaagtaacagaaaaatacagtgaaaacctaatgaatttacctngcaagctattggaagttttataataancnatggnattaaga

SEQ ID NO: 243 - DNA, 698 bp, Trifolium repens
  misc_feature (3)..(3): n is a, c, g, or t
  misc_feature (9)..(10): n is a, c, g, or t
  misc_feature (17)..(17): n is a, c, g, or t
  misc_feature (26)..(26): n is a, c, g, or t
  misc_feature (685)..(685): n is a, c, g, or t
gtnaccagnntgttgancttgtgagnattggggtatttttcaggttgttgatcatggtgttgatacaagacttgtttctgagatgacccgttttgctagagagttttttgctttgccaccggaagagaagctccggtttgacatgtccggtggtaaaaagggtggtttcattgtctctagtcatctccaaggagaagcagtgaaggattggagagagctagtgacatatttttcatacccaattaaacaaagagattattcaaggtggccagacaagccagaaggatggaaagaggtaacagaaaaatacagtgaaaacctaatgaatttagcttgcaaactattggaagttttatcagaagcaatgggtttagaaaaagaagctctaacaaaagcatgtgttgatatggatcaaaaagttgttataaattattacccaaaatgccctgaacctgacctcacacttggccttaaacgtcacactgaccctggcacaattactcttttgcttcaagatcaagttggtggtcttcaagctaccaaagataatggtaagacgtggattacagttcaaccagttgaaggtgcttttgttgttaatcttggagaccatggtcactatctaagtaatggacggttcaaaaatgctgaccatcaagcagtggtgaattcgaactacagccgnttatcaatagcaa

SEQ ID NO: 244 - DNA, 579 bp, Trifolium repens
  misc_feature (4)..(4): n is a, c, g, or t
  misc_feature (20)..(20): n is a, c, g, or t
  misc_feature (29)..(29): n is a, c, g, or t
  misc_feature (83)..(83): n is a, c, g, or t
atcnaaaagttgtgataaantattacccnaaatgccctgaacctgacctcacacttggccttaaacgccacactgaccctggnacaattactcttttgcttcaagatcaagttggtggccttcaagctaccaaagataatggtaagacgtggattacagttcaaccagttgaaggtgcttttgttgttaatcttggagaccatggtcattatctaagtaatggacggttcaaaaatgctgaccaccaagcagtggtgaattcgaactacagccgtttatcaatagcaacatttcaaaatccagctcccgatgcaactgtataccctttgaagattagagagggtgaaaaatctgtgttggaagaaccaatcacttttgctgaaatgtatagaaggaagatgaccaaagaccttgaaattgctaggatgaagaagttggctaaggaacaacaacttagggacttggaggagaacaagactaaatatgaggccaaacctttgaatgagatctttgcttaattaattagtcttaatttaaataattaataaattttagacttaatttacatataataatttt

SEQ ID NO: 245 - DNA, 601 bp, Trifolium repens
  misc_feature (2)..(2): n is a, c, g, or t
  misc_feature (22)..(22): n is a, c, g, or t
  misc_feature (30)..(30): n is a, c, g, or t
gnagcataacataaaccctgtncccgattnatgtaacacaatctccccttttcttattacaagtaaaataccataacacaataatatgaataccataatcttgaatcatacaaacaaccttggatcaaacaaaacaacaaccatggttgatctagaaacagaaccaagttcaccatttattcaatccccagaacacagaccaaaatcctcaataatcattgctgaaggtatccctctaattgatctcactcctataaactacaaagatgaaatcatcaccaacccactttccattgaagacttagtcaaagaaataggcaaagcatgtaaagaatggggtttctttcaagtgattaatcacaaagttcctttggataaacgtgaaaggattgaagaatcttcaaagaagttttttgaacttagtttggaggaaaaacttaaggtgagaagagatgaagttaatttgcttggttattttgaagctgagcatacaaaaaatgttagggactggaaggaaatttatgattttaatgtgcaacaaccaacttttataccaccttcggatgaccaaagttttcagtttcaatgggaaaatcgatgg

SEQ ID NO: 246 - protein, 172 aa, Trifolium repens
MNTIILNHTNNLGSNKTTTMVDLETEPSSPFIQSPEHRPKSSIIIAEGIPLIDLTPINYKDEIITNPLSIEDLVKEIGKACKEWGFFQVINHKVPLDKRERIEESSKKFFELSLEEKLKVRRDEVNLLGYFEAEHTKNVRDWKEIYDFNVQQPTFIPPSDDQSFQFQWENRW

SEQ ID NO: 247 - DNA, 585 bp, Trifolium repens
  misc_feature (13)..(13): n is a, c, g, or t
ttacccaacaatnatgtgtgactgatgttagtgtaccaggaaagatgggagaggtggatccagctttcttcaaatccagaaaataggccaaaactttccataatccaagctgaaggaattcctgtaatcaatctctccccattaattcaccacacagttcaagactcctctgccattgaaagcttagtcaaagaaataggaaatgcttgcaaggaatggggtttcttccaagtaacaaaccatggtgtccctctaaatctaaggctcagactcgaggaagctaccaaagttttctttgcacagagtttggaggagaagaggaagcttaccgtagatgataacagtttgcctggttatcatgatacagagcacaccaagaatgtcagagactggaaagaagtgtttgattttttatccaaagaccccactttgattcctctgaattctgatgaacatgatgatcgagtcactcaatggactaatccatcccctcaatatcctccaaacttcaaagttattttggaagagtatattaaagagatggaaaagctaggctttaagttgctagagcttatagctttgagc

SEQ ID NO: 248 - protein, 171 aa, Trifolium repens
NPENRPKLSIIQAEGIPVINLSPLIHHTVQDSSAIESLVKEIGNACKEWGFFQVTNHGVPLNLRLRLEEATKVFFAQSLEEKRKLTVDDNSLPGYHDTEHTKNVRDWKEVFDFLSKDPTLIPLNSDEHDDRVTQWTNPSPQYPPNFKVILEEYIKEMEKLGFKLLELIALS

SEQ ID NO: 249 - DNA, 604 bp, Trifolium repens
gggaatggtggaggcgaatgtgaccctagggctgatgaattagtaatggtagttgagcttatggcgttagctggagttttcaatattggtgattttgttcctgctttggaatggttagatattcaaggtgtacaaggaaaaatgaagaaattacataaaagatttgatgcatttttaactagcattattgaagatcacatgatttccaagagtgagaagcataatgacttattgagtacgttgttatcactaaaagaaaaagttgatgaggatggtgacaaacttaatgatactgagatcaaagcattactcttgaacatgttcacagctggaacagacacatcatcaagcacaacagagtgggctattgctgaactaataaaaaatccaaaactaatgattcgtgttcaaaatgagttggacactgttgtgggccgagacaagcttgtaactgaacaagacttggcccatcttccttacttagaggctgtaataaaggagacatttcgtctccatccatcaacccctctttctctcccacgtgttgcaacaaatagttgtgaaatcctcgactatcacattcccaaaggtgcaactctcttgg

SEQ ID NO: 250 - protein, 201 aa, Trifolium repens
GNGGGECDPRADELVMVVELMALAGVFNIGDFVPALEWLDIQGVQGKMKKLHKRFDAFLTSIIEDHMISKSEKHNDLLSTLLSLKEKVDEDGDKLNDTEIKALLLNMFTAGTDTSSSTTEWAIAELIKNPKLMIRVQNELDTVVGRDKLVTEQDLAHLPYLEAVIKETFRLHPSTPLSLPRVATNSCEILDYHIPKGATLL

SEQ ID NO: 251 - DNA, 581 bp, Trifolium repens
gggaatggtggaggcgaatgtgaccctagggctgatgaatttaagtaatggtagttgagcttatggcgttagctggagttttcaatattggtgattttgttcctgctttggaatggttagatattcaaggtgtacaaggaaaaatgaagaaattacataaaagatttgatgcatttttaactagcattattgaagatcacatgatttccaagagtgagaagcataatgacttattgagtacgttgttatcactaaaagaaaaagttgatgaggatggtgacaaacttaatgatactgagatcaaagcattactcttgaacatgttcacagctggaacagacacatcatcaagcacaacagagtgggctattgctgaactaataaaaaatccaaaactaatgattcgtgttcaaaatgagttggacactgttgtgggccgagacaagcttgtaactgaacaagacttggcccatcttccttacttagaggctgtaataaaggagacatttcgtctccatccatcaacccctctttctctcccacgtgttgcaacaaatagttgtgaaatcctcgactatcac

SEQ ID NO: 252 - DNA, 603 bp, Trifolium repens
  misc_feature (44)..(44): n is a, c, g, or t
aatggtggaggtgaatgtgaccctagggctgatgaatttaagtnatggtagttgagcttatggcgttagctggagttttcaatattggtgattttgttcctgctttggaatggttagatattcaaggtgtacaaggaaaaatgaagaaattacataaaagatttgatgcatttttaactagcattattgaagatcacatgatttccaagagtgagaagcataatgacttattgagtacgttgttatcactaaaagaaaaagttgatgaggatggtgacaaacttaatgatactgagatcaaagcattactcttgaacatgttcacagctggaacagacacatcatcaagcacaacagagtgggctattgctgaactaataaaaaatccaaaactaatgattcgtgttcaaaatgagttggacactgttgtgggccgagacaagcttgtaactgaacaagacttggcccatcttccttacttagaggctgtaataaaggagacatttcgtctccatccatcaacccctctttctctcccacgtgttgcaacaaatagttgtgaaatcctcgactatcacattcccaaaggtgcaactctcttgg

SEQ ID NO: 253 - DNA, 621 bp, Trifolium repens
  misc_feature (2)..(2): n is a, c, g, or t
  misc_feature (38)..(38): n is a, c, g, or t
  misc_feature (40)..(40): n is a, c, g, or t
  misc_feature (44)..(44): n is a, c, g, or t
  misc_feature (47)..(47): n is a, c, g, or t
  misc_feature (58)..(58): n is a, c, g, or t
  misc_feature (91)..(91): n is a, c, g, or t
  misc_feature (104)..(105): n is a, c, g, or t
  misc_feature (120)..(120): n is a, c, g, or t
  misc_feature (124)..(124): n is a, c, g, or t
  misc_feature (566)..(566): n is a, c, g, or t
  misc_feature (598)..(598): n is a, c, g, or t
gnaggaaatttcaactaaatattgcctttaattctttntnatanatntttgaatttcnttctccctaaaaattctatagctaccacatcancacaacataacannaattaagaaatattntatntactattttaagatatggaagtagtagcagcagcaatcacaaaaaacaatggcaagattgattcattttgcttgaatcatgctaatgctaataacatgaaagtgaatggtgctgatcctttgaattggggtgtggctgctgaggcaatgaagggaagtcacttggatgaggtgaagcgtatggtggaggaataccggaaaccggttgtccgtcttggtggcgagacactgacgatttctcaggtggctgccattgctgcacacgatggtgcaacggtggagctatcggaatctgctagagccggcgttaaggcgagcagtgactgggttatggagagtatgaacaaaggtacagacagttatggtgtcactacagggttcggcgctacctcgcaccgccgaaccaaacaaggtggtgctttgcagaaagagctcataaggtnttttgaatgcaggaatatttggaaatggaacntgagacaaagccacacactaccc

SEQ ID NO: 254 - protein, 159 aa, Trifolium repens
MEVVAAAITKNNGKIDSFCLNHANANNMKVNGADPLNWGVAAEAMKGSHLDEVKRMVEEYRKPVVRLGGETLTISQVAAIAAHDGATVELSESARAGVKASSDWVMESMNKGTDSYGVTTGFGATSHRRTKQGGALQKELIRFECRNIWKWNRQSHTLP

SEQ ID NO: 255 - DNA, 582 bp, Trifolium repens
  misc_feature (2)..(3): n is a, c, g, or t
  misc_feature (11)..(11): n is a, c, g, or t
  misc_feature (38)..(38): n is a, c, g, or t
  misc_feature (40)..(40): n is a, c, g, or t
  misc_feature (44)..(44): n is a, c, g, or t
  misc_feature (47)..(47): n is a, c, g, or t
  misc_feature (91)..(91): n is a, c, g, or t
  misc_feature (104)..(105): n is a, c, g, or t
  misc_feature (120)..(120): n is a, c, g, or t
  misc_feature (124)..(124): n is a, c, g, or t
  misc_feature (154)..(154): n is a, c, g, or t
  misc_feature (405)..(405): n is a, c, g, or t
  misc_feature (516)..(516): n is a, c, g, or t
  misc_feature (549)..(549): n is a, c, g, or t
gnnggaaattncaactaaatattgcctttaattctttntnatanatntttgaatttccttctccctaaaaattctatagctaccacatcancacaacataacannaattaagaaatattntatntactattttaagatatggaagtagtagcancagcaatcacaaaaaacaatggcaagattgattcattttgcttgaatcatgctaatgctaataacatgaaagtgaatggtgctgatcctttgaattggggtgtggctgctgaggcaatgaagggaagtcacttggatgaggtgaagcgtatggtggaggaataccggaaaccggttgtccgtcttggtggcgagacgctgacgatttctcaggtggctgccattgctgcacacgatggtgcaacggtgganctatcggaatctgctagagccggcgttaaggcgagcagtgactgggttatggagagcatgaacaaaggtacagacagttatggtgtcactacggggttcggcgctacctcncaccgccgaaccaaacaaggtggtgctttgcanaaagagctcataagctaatttgcttgtgtcaat

SEQ ID NO: 256 - DNA, 621 bp, Trifolium repens
  misc_feature (2)..(2): n is a, c, g, or t
  misc_feature (24)..(24): n is a, c, g, or t
  misc_feature (40)..(40): n is a, c, g, or t
  misc_feature (44)..(44): n is a, c, g, or t
  misc_feature (47)..(47): n is a, c, g, or t
  misc_feature (58)..(58): n is a, c, g, or t
  misc_feature (91)..(91): n is a, c, g, or t
  misc_feature (104)..(105): n is a, c, g, or t
  misc_feature (120)..(120): n is a, c, g, or t
  misc_feature (124)..(124): n is a, c, g, or t
  misc_feature (131)..(131): n is a, c, g, or t
  misc_feature (566)..(566): n is a, c, g, or t
  misc_feature (598)..(598): n is a, c, g, or t
  misc_feature (605)..(605): n is a, c, g, or t
gnaggaaattacaactaaatattncctttaattctttatnatanatntttgaatttcnttctccctaaaaattctatagctaccacatcancacaacataacannaattaagaaatattntatntactatnttaagatatggaagtagtagcagcagcaatcacaaaaaacaatggcaagattgattcattttgcttgaatcatgctaatgctaataacatgaaagtgaatggtgctgatcctttgaattggggtgtggctgctgaggcaatgaagggaagtcacttggatgaggtgaagcgtatggtggaggaataccggaaaccggttgtccgtcttggtggcgagacactaaccatttctcaggtggctgccattgctgcacacgatggtgcaacggtggagctatcggaatctgctagagccggcgttaaggcaagcagtgactgggttatggagagtatgaacaaaggtaccgacagctacggtgtcccaacagggttcggcgctacctcgcaccgccgaaccaaacaaggtggtgctttgcagaaagagctcataaggtnttttgaatgctggaatatttggaaatggaacntgagtcnaagccacacactaccc

SEQ ID NO: 257 - DNA, 600 bp, Trifolium repens
  misc_feature (20)..(21): n is a, c, g, or t
  misc_feature (28)..(28): n is a, c, g, or t
  misc_feature (33)..(33): n is a, c, g, or t
  misc_feature (42)..(42): n is a, c, g, or t
  misc_feature (48)..(48): n is a, c, g, or t
  misc_feature (57)..(57): n is a, c, g, or t
  misc_feature (127)..(128): n is a, c, g, or t
  misc_feature (556)..(556): n is a, c, g, or t
  misc_feature (592)..(592): n is a, c, g, or t
tcaagaaattacactctttnnttctttntaatntttgttttnatttcnttctctctncaaatactatagttaccaaaacataacaaagtaacacttattactagctattatttgtatcaatttaagnnatggaagtagtagcagcagcaatcacaaaaaacaacggaaagattgattcattttgcttgaatcatgctaatgctaataacatgaaagtgaatggtgctgatcctttgaattggggtgtggctgctgaggcaatgaaaggaagtcacttggatgaggtgaagtgtatggtggaggagtatcgaaaaccggttgtccgtcttggtggcgagacactgacgatttctcaagtggctgccattgctgcacacgatggtgcgacggtggagctatcggaatctgctagagccggcgttaaggcgagcagtgactgggttatggaaagtatgaacaaaggtactgacagttatggtgtcactacagggttcggcgctacctcgcaccgccgaaccaaacaaggtggtgctttgcagaaagagctcataaggtnttttgaatgcaggaatatttggaaatggaacttganacaaatcc

SEQ ID NO: 258 - DNA, 693 bp, Trifolium repens
  misc_feature (2)..(2): n is a, c, g, or t
  misc_feature (9)..(9): n is a, c, g, or t
  misc_feature (14)..(14): n is a, c, g, or t
  misc_feature (47)..(47): n is a, c, g, or t
  misc_feature (52)..(52): n is a, c, g, or t
  misc_feature (60)..(60): n is a, c, g, or t
  misc_feature (86)..(86): n is a, c, g, or t
  misc_feature (95)..(95): n is a, c, g, or t
gnaggaaanaattntattgttattatttccccccacacaacggaaanaattntattgttncttatttccccccacacaacataacnaatacattntcctctcctctcatcacaattattactttctacacacccccctctcaactattattaactaacataatggagggaattaccaatggccatgctgaagcaactttttgcgtgaccaaaagtgttggtgatccactcaactggggtgcagccgcggagtcgttgatggggagtcatttggatgaggtgaagcgtatggtggaggaataccgtaatccattggttaaaattggcggcgagacgcttaccattgctcaggtggctggaattgcttctcatgatagtggtgtgagggtggagctgtctgagtccgccagggccggcgttaaggcgagtagtgattgggtgatggacagcatgaacaatgggactgatagttatggtgttaccaccggtttcggcgccacctctcaccggagaaccaagcagggtggtgccttgcagaaggagctaattaggtttttgaatgctggaatatttggcaatggtacagaatctaactgtacactaccacacacagcaaccagagctgcaatgcttgtgagaatcaacactcttcttcaagaggaatatttcttgaatggcctttgtaaatttttgg

SEQ ID NO: 259 - protein, 177 aa, Trifolium repens
MEGITNGHAEATFCVTKSVGDPLNWGAAAESLMGSHLDEVKRMVEEYRNPLVKIGGETLTIAQVAGIASHDSGVRVELSESARAGVKASSDWVMDSMNNGTDSYGVTTGFGATSHRRTKQGGALQKELIRFLNAGIFGNGTESNCTLPHTATRAAMLVRINTLLQEEYFLNGLCKFL

SEQ ID NO: 260 - DNA, 592 bp, Trifolium repens
  misc_feature (2)..(2): n is a, c, g, or t
  misc_feature (9)..(9): n is a, c, g, or t
  misc_feature (14)..(14): n is a, c, g, or t
  misc_feature (53)..(53): n is a, c, g, or t
  misc_feature (60)..(60): n is a, c, g, or t
  misc_feature (77)..(77): n is a, c, g, or t
  misc_feature (86)..(87): n is a, c, g, or t
  misc_feature (92)..(92): n is a, c, g, or t
  misc_feature (96)..(96): n is a, c, g, or t
  misc_feature (99)..(99): n is a, c, g, or t
  misc_feature (101)..(102): n is a, c, g, or t
  misc_feature (105)..(106): n is a, c, g, or t
  misc_feature (128)..(128): n is a, c, g, or t
  misc_feature (592)..(592): n is a, c, g, or t
gnaggaaanaattntattgttattatttccccccacacaacataacaaatacnattattnctctcctctcatcacanattattacnntttcntacnacncnnctnncctctcaactattattaactangcataatggagggaattaccaatggccagctgctttcaaaaaaaaaccaatggccatgctgaaacaactttttgcgtgaccaaaagtgttggtgatccactcaactggggtgcagccgcggagtcgttgacgggtagtcatttggatgaggtgaagcgtatggtggaggagtaccgtaatccgttggttaaaattggcggcgagacgcttaccattgctcaggtggctggaattgcttctcatgatagtggtgtgagggtggagctgtccgagtccgcaagggccggcgttaaggcgagtagtgattgggtgatggatagcatgaacaatgggactgatagttacggtgttaccaccggttttggtgccacctctcaccggagaaccaagcagggtggtgccttgcagaaggagctaattaggtttttgaatgctggaatatttggcaatggtacagaatctan

SEQ ID NO: 261 - DNA, 618 bp, Trifolium repens
  misc_feature (8)..(8): n is a, c, g, or t
  misc_feature (13)..(13): n is a, c, g, or t
  misc_feature (21)..(22): n is a, c, g, or t
  misc_feature (56)..(56): n is a, c, g, or t
  misc_feature (91)..(92): n is a, c, g, or t
gaggaaanaattntattgttnntttttcctacccacacaacataacaaatacattntcctctcctctcatcacaattattactttctacanncccccctctcaagtattattaactaacataatggagggaattaccaatggccatgctgaagcaactttttgcgtgaccaaaagtgttggtgatccactcaactggggtgcagccgcggagtcgttgatggggagtcatttggatgaggtgaagcgtatggtggaggaataccgtaatccattggttaaaattggcggcgagacgcttaccattgctcaggtggctggaattgcttctcatgatagtggtgtgagggtggagctgtctgagtccgcgagggccggcgttaaggcgagtagtgattgggtgatggacagcatgaacaatgggactgatagttatggtgttaccaccggtttcggtgccacctctcaccggagaaccaagcaaggtggtgccttgcagaaggagctaattaggtttttgaatgctggaatatttggcaatggtacagaatctaactgtacactaccacacacagcaaccagagctgcaatgcttgtgagaatcaacactcttcttcaag

SEQ ID NO: 262 - DNA, 654 bp, Trifolium repens
  misc_feature (9)..(9): n is a, c, g, or t
  misc_feature (14)..(14): n is a, c, g, or t
  misc_feature (19)..(19): n is a, c, g, or t
  misc_feature (21)..(21): n is a, c, g, or t
  misc_feature (38)..(38): n is a, c, g, or t
  misc_feature (47)..(47): n is a, c, g, or t
  misc_feature (58)..(58): n is a, c, g, or t
  misc_feature (60)..(60): n is a, c, g, or t
  misc_feature (66)..(66): n is a, c, g, or t
  misc_feature (89)..(90): n is a, c, g, or t
  misc_feature (167)..(167): n is a, c, g, or t
  misc_feature (216)..(216): n is a, c, g, or t
  misc_feature (228)..(228): n is a, c, g, or t
  misc_feature (245)..(245): n is a, c, g, or t
  misc_feature (338)..(338): n is a, c, g, or t
  misc_feature (340)..(340): n is a, c, g, or t
  misc_feature (364)..(364): n is a, c, g, or t
  misc_feature (383)..(383): n is a, c, g, or t
  misc_feature (398)..(398): n is a, c, g, or t
  misc_feature (410)..(410): n is a, c, g, or t
  misc_feature (437)..(437): n is a, c, g, or t
  misc_feature (440)..(440): n is a, c, g, or t
  misc_feature (565)..(565): n is a, c, g, or t
  misc_feature (580)..(580): n is a, c, g, or t
  misc_feature (583)..(583): n is a, c, g, or t
  misc_feature (601)..(602): n is a, c, g, or t
  misc_feature (608)..(608): n is a, c, g, or t
  misc_feature (617)..(618): n is a, c, g, or t
ccttgaatnattgntttgncncacccaacacaacatanacaaatacnatttcttgctncnctactngcatcacaattattactttctanncacccccctctcaactattattaactaacataatggagggaattactaatggccatgctgaagcaactttttgcgtnaccaaaagtgttggtgatccactcaactggggtgcagccgcggagtcgntgatggggagtnatttggatgaggtgaancgtatggtggaggaataccgtaatccattggttaaaattggcggcgagacgcttaccattgctcaggtggctggaattgcttctcatgatagngntgtgagggtggagctgtctgagtncgccagggccggcgttaangcgagtagtgattgngtgatggacagnatgaacaatgggactgatagttatggngtnaccaccggtttcggcgccacctctcaccggagaaccaagcagggtggtgccttgcaaaaggagctaattatgtttttgaatgctggaatatttggcaatggtacagaatctaactgtacacttcnacacacagcaaccanagntgcattgctttggtgcannatcacncttcttctnnaggaatatttcttgaatggcctttgtaaatttttgg

SEQ ID NO: 263 - DNA, 590 bp, Trifolium repens
  misc_feature (6)..(6): n is a, c, g, or t
  misc_feature (13)..(13): n is a, c, g, or t
  misc_feature (19)..(21): n is a, c, g, or t
  misc_feature (37)..(37): n is a, c, g, or t
  misc_feature (45)..(45): n is a, c, g, or t
  misc_feature (54)..(54): n is a, c, g, or t
  misc_feature (66)..(66): n is a, c, g, or t
  misc_feature (89)..(90): n is a, c, g, or t
ggaaanaattatnttgttnnntttttccccccacacnacataacnaatacattntcttctcctctnatcacaattattactttctacanncccccctctcaactattattaactaacataatggagggaattactaatggccatgctgaagcaactttttgcgtgaccaaaagtgttggtgatccactcaactggggtgcagccgcggagtcgttgatggggagtcatttggatgaggtgaagcgtatggtggaggaataccgtaatccattggttaaaattggcggcgagacgcttaccattgctcaggtggctggaattgcttctcatgatagtggtgtgagggtggagctgtctgagtccgccagggccggcgttaaggcgagtagtgattgggtgatggacagcatgaacaatgggactgatagttatggtgttaccaccggtttcggcgccacctctcaccggagaaccaagcagggtggtgccttgcagaaggagctaattaggtttttgaatgctggaatatttggcaatggtacagaatctaactgtacactaccacacacggcaaccagagctgcaatgct

SEQ ID NO: 264 - DNA, 616 bp, Trifolium repens
  misc_feature (6)..(6): n is a, c, g, or t
  misc_feature (29)..(29): n is a, c, g, or t
  misc_feature (54)..(54): n is a, c, g, or t
ggaaanaattatattgttccttatttccncccacacaacataacaaatacattntcctctcctctcatcacaattattactttctacacccccccctctcaactattattaactaacataatggagggaattaccaatggccatgctgaagcaactttttgcgtgaccaaaagtgttggtgatccactcaactggggtgcagccgcggagtcgttgatggggagtcatttggatgaggtgaagcgtatggtggaggaataccgtaatccattggttaaaattggcggcgagacgcttaccattgctcaggtggctggaattgcttctcatgatagtggtgtgagggtggagctgtctgagtccgccagggccggcgttaaggcgagtagtggttgggtgatggacagcatgaacaatgggactgatagttatggtgttaccactggtttcggcgccacctctcaccggagaaccaagcagggtggtgccttgcagaaggagctaattaggtttttgaatgccggaatatttggcaatggtacagaatctaactgtacactaccacacacagcaaccagagctgcaatgcttgtgagaatcaacactcttcttcaag

SEQ ID NO: 265 - DNA, 441 bp, Trifolium repens
  misc_feature (5)..(5): n is a, c, g, or t
  misc_feature (10)..(10): n is a, c, g, or t
  misc_feature (12)..(12): n is a, c, g, or t
  misc_feature (18)..(18): n is a, c, g, or t
  misc_feature (28)..(28): n is a, c, g, or t
  misc_feature (44)..(44): n is a, c, g, or t
  misc_feature (86)..(87): n is a, c, g, or t
  misc_feature (354)..(355): n is a, c, g, or t
  misc_feature (402)..(402): n is a, c, g, or t
  misc_feature (426)..(426): n is a, c, g, or t
  misc_feature (430)..(430): n is a, c, g, or t
  misc_feature (434)..(434): n is a, c, g, or t
  misc_feature (437)..(437): n is a, c, g, or t
  misc_feature (440)..(441): n is a, c, g, or t
gaaanaattntnttgttnattatttccncccacacaacataacnaatacattattctctcctctcatcacaattattactttctanncaccctcctctcaactattattaactagcataatggagggaattaccaatggccatgctgaaacaactttttgcgtgaccaaaagtgttggtgatccactcaactggggtgcagccgcggagtcgttgacggggagtcatttggatgaggtgaagcgtatggtggaggagtaccgtaatccgttggctaaaattggcggcgagacgcttaccattgctcaggtggctggaattgcttctcatgatagtggtgtgagggtggagctgnncgagtccgcaagggccggcgttaaggcgagtactgattgggtgatgnataacatgaacaatgggactgatnggtncggngcnacnn

SEQ ID NO: 266 - DNA, 567 bp, Trifolium repens
  misc_feature (5)..(5): n is a, c, g, or t
  misc_feature (10)..(10): n is a, c, g, or t
  misc_feature (12)..(12): n is a, c, g, or t
  misc_feature (53)..(53): n is a, c, g, or t
gaaanaattntnttgttccttatttccccccacacaacataacaaatacattntcctctcctctcatcacaattattactttctacacccccccctctcaactattattaactaacataatggagggaattaccaatggccatgctgaagcaactttttgcgtgaccaaaagtgttggtgatccactcaactggggtgcagccgcggagtcgttgatggggagtcatttggatgaggtgaagcgtatggtggaggaataccgtaatccattggttaaaattggcggcgagacgcttaccattgctcaggtggctggaattgcttctcatgatagtggtgtgagggtggagctgtctgagtccgccagggccggcgttaaggcgagtagtggttgggtgatggacagcatgaacaatgggactgatagttatggtgttaccactggtttcggcgccacctctcaccggagaaccaagcagggtggtgccttgcagaaggagctaattaggtttttgaatgccggaatatttggcaatggtacagaatctaactgtacactaccacacc

SEQ ID NO: 267 - DNA, 532 bp, Trifolium repens
  misc_feature (2)..(2): n is a, c, g, or t
  misc_feature (6)..(6): n is a, c, g, or t
  misc_feature (8)..(8): n is a, c, g, or t
  misc_feature (13)..(13): n is a, c, g, or t
  misc_feature (17)..(17): n is a, c, g, or t
  misc_feature (30)..(30): n is a, c, g, or t
  misc_feature (35)..(35): n is a, c, g, or t
  misc_feature (38)..(39): n is a, c, g, or t
  misc_feature (41)..(42): n is a, c, g, or t
  misc_feature (48)..(51): n is a, c, g, or t
  misc_feature (53)..(53): n is a, c, g, or t
  misc_feature (63)..(63): n is a, c, g, or t
  misc_feature (72)..(72): n is a, c, g, or t
  misc_feature (78)..(78): n is a, c, g, or t
  misc_feature (94)..(94): n is a, c, g, or t
anatananaatcntatnttctctcctctantaacnatnntnnctttcnnnncnccctcctctnaactattantaactngcataatggagggaantaccaatggccatgctgaaacaactttttgcgtgaccaaaagtgttggtgatccactcaactggggtgcagccgcggagtcgtcgacggggagtcatttggatgaggtgaagcgtatggtggaggagtaccgtaatccgttggttaaaattggcggcgagacgcttaccattgctcaggtggctggaattgcttctcatgatagtggtgtgagggtggagctgtccgagtccgcaagggccggcgttaaggcgagtagtgattgggtgatggatagcatgaacaatgggactgatagttacggtgttaccaccggttttggtgccacctctcaccggagaaccaagcagggtggtgccttgcagaaggagctaattaggtttttgaatgctggaatatttggcaatggtacagaatctaactttacactaccacacac

SEQ ID NO: 268 - DNA, 579 bp, Trifolium repens
aacaagatcgttatgccttagaacttcacctcaatggcttggtcctttgattgaagtgataagattttcaaccaaatcaattgaaagagaaattaactcggtcaacgacaaccctttgatcgatgtttcaaggaacaaggccattcatggtggtaactttcaaggaacacctattggagtttcaatggataacacacgtttagctcttgcttcaattggtaaactcatgtttgctcaattctctgaacttgttaatgatttttacaacaacgggttgccttcgaatcttactgctagtaggaacccgagcttggactatggtttcaagggatcggaaattgccatggcttcgtattgttccgagttacaatatcttgctaatcctgtcaccacccatgtccaaagtgccgagcaacacaaccaagatgttaactctttgggtttgatttcatctagaaaaacaaatgaagctattgagattctcaagctcatgtcttccactttcttgattgcattatgtcaagcaatcgacttaaggcacttggaggaaaatctcaggaacaccgtcaagaacacggt

SEQ ID NO: 269 - protein, 192 aa, Trifolium repens
TRSLCLRTSPQWLGPLIEVIRFSTKSIEREINSVNDNPLIDVSRNKAIHGGNFQGTPIGVSMDNTRLALASIGKLMFAQFSELVNDFYNNGLPSNLTASRNPSLDYGFKGSEIAMASYCSELQYLANPVTTHVQSAEQHNQDVNSLGLISSRKTNEAIEILKLMSSTFLIALCQAIDLRHLEENLRNTVKNT

SEQ ID NO: 270 - DNA, 591 bp, Trifolium repens
  misc_feature (8)..(8): n is a, c, g, or t
  misc_feature (15)..(15): n is a, c, g, or t
  misc_feature (41)..(41): n is a, c, g, or t
  misc_feature (66)..(66): n is a, c, g, or t
ggtcaatncagcttnggagatctagtccccctttcttactntgctggtttactaactggaagaccnaattctaaagctcatgggcctacaggagaagtacttaatgcaaaagaagcttttcaattggctggaatcaataccgagttctttgaattacaaccaaaagaaggtcttgcacttgttaatggaactgctgttggttctggtttagcttctattgttctttttgaggctaacatattggcggtgttgtctgaagttctatcggcaattttcgctgaagttatgcaagggaagcccgaatttactgatcatttgacacataagttgaagcaccaccctggtcaaattgaggctgctgctattatggaacacattttggatgggagtgcttatgttaaagacgcgaagaagttgcatgagatggaccctttacagaagccaaagcaagatagatatgcacttagaacttcaccacaatggcttggtcctttgattgaagtgattagattttcaaccaagtcaattgagagagagatcaactctgtcaatgacaaccctttgattgatgtttcgagaaacaaggctttg

SEQ ID NO: 271 - protein, 197 aa, Trifolium repens
  misc_feature (3)..(3): Xaa can be any naturally occurring amino acid
  misc_feature (5)..(5): Xaa can be any naturally occurring amino acid
  misc_feature (14)..(14): Xaa can be any naturally occurring amino acid
  misc_feature (22)..(22): Xaa can be any naturally occurring amino acid
GQXSXGDLVPLSYXAGLLTGRXNSKAHGPTGEVLNAKEAFQLAGINTEFFELQPKEGLALVNGTAVGSGLASIVLFEANILAVLSEVLSAIFAEVMQGKPEFTDHLTHKLKHHPGQIEAAAIMEHILDGSAYVKDAKKLHEMDPLQKPKQDRYALRTSPQWLGPLIEVIRFSTKSIEREINSVNDNPLIDVSRNKAL

SEQ ID NO: 272 - DNA, 592 bp, Trifolium repens
  misc_feature (2)..(3): n is a, c, g, or t
  misc_feature (11)..(11): n is a, c, g, or t
  misc_feature (18)..(18): n is a, c, g, or t
  misc_feature (22)..(22): n is a, c, g, or t
  misc_feature (30)..(30): n is a, c, g, or t
  misc_feature (37)..(37): n is a, c, g, or t
  misc_feature (508)..(508): n is a, c, g, or t
  misc_feature (579)..(579): n is a, c, g, or t
  misc_feature (585)..(585): n is a, c, g, or t
  misc_feature (592)..(592): n is a, c, g, or t
gnnggaaattncaactcnattntttctttntataatntttgaatttccttctctctcaaattctatagctactctaccacatcacacaacataacaaattaagaaatattcattactatactattaagatatggaagtagtagcagcagcaatcacaaaaaacaacggcaagattgattcattttgcttgaatcatgctaatgctaataacatgaaagtgaatgatgctgatcctttgaattggggtgtggctgctgaggcaatgaagggaagtcacttggatgaggtgaaacgtatggtggaggagtaccggaagccgattgtccgtcttggtggcgagacgctgacgatttctcaggtggctgccattgctgcacacgatggtgcgatggttgagctgtcggaatctgctagagccggcgttaaggcaagcagtgattgggttatggagagtatgaacaaaggtactgacagttatggtgtcaccacagggttcggcgctacctcncaccgccgaaccaaacaaggtggtgctttacagaaagggctcataaggtttttgaatgctggaatatttgnaaatgnaactgan

SEQ ID NO: 273 - protein, 154 aa, Trifolium repens
  misc_feature (126)..(126): Xaa can be any naturally occurring amino acid
  misc_feature (150)..(150): Xaa can be any naturally occurring amino acid
  misc_feature (152)..(152): Xaa can be any naturally occurring amino acid
  misc_feature (154)..(154): Xaa can be any naturally occurring amino acid
MEVVAAAITKNNGKIDSFCLNHANANNMKVNDADPLNWGVAAEAMKGSHLDEVKRMVEEYRKPIVRLGGETLTISQVAAIAAHDGAMVELSESARAGVKASSDWVMESMNKGTDSYGVTTGFGATXHRRTKQGGALQKGLIRFLNAGIFXNXTX

SEQ ID NO: 274 - DNA, 566 bp, Trifolium repens
  misc_feature (2)..(2): n is a, c, g, or t
  misc_feature (12)..(12): n is a, c, g, or t
  misc_feature (19)..(19): n is a, c, g, or t
  misc_feature (164)..(165): n is a, c, g, or t
  misc_feature (168)..(168): n is a, c, g, or t
  misc_feature (186)..(186): n is a, c, g, or t
  misc_feature (239)..(239): n is a, c, g, or t
  misc_feature (259)..(259): n is a, c, g, or t
  misc_feature (295)..(296): n is a, c, g, or t
  misc_feature (301)..(301): n is a, c, g, or t
  misc_feature (384)..(384): n is a, c, g, or t
  misc_feature (435)..(435): n is a, c, g, or t
  misc_feature (469)..(469): n is a, c, g, or t
  misc_feature (498)..(499): n is a, c, g, or t
  misc_feature (511)..(511): n is a, c, g, or t
  misc_feature (517)..(517): n is a, c, g, or t
  misc_feature (522)..(522): n is a, c, g, or t
  misc_feature (529)..(530): n is a, c, g, or t
  misc_feature (545)..(545): n is a, c, g, or t
  misc_feature (553)..(553): n is a, c, g, or t
cnattgttagtngtttccncccacccacataacaaatacataattctctcctctgatcacaattattactttactacaccctcctctcaactattattaactagcataatggagggaattaccaatggccatgctgaaacaacttttagcgtgaccaaaagtgnnggngatccactcaactggcgngcagccgcggagtcgtcgacggggagtcatttggatgaggtgaagcgtatggnggaggagtaccgtaatccgntggttaaaattggcggcgagacgcttaccattgctnnggtanctggaattgcttctcatgatagtggagtgagggtggagctgtccgagttcgcaagggccggcgttaaggcgagtagtgattgngtgatggatagcatgaacaatgggactgatagttacggtgttaccaccgcntttggtgccacctgtcaccggagaaccaagccanggtggtgccttgcagaaggagctaaattnnggtgttttgaangctggnaatantttggcnntggttcagaaatctnaacttgtncacttaccacacc

SEQ ID NO: 275 - protein, 152 aa, Trifolium repens
  misc_feature (19)..(20): Xaa can be any naturally occurring amino acid
  misc_feature (26)..(26): Xaa can be any naturally occurring amino acid
  misc_feature (44)..(44): Xaa can be any naturally occurring amino acid
  misc_feature (51)..(51): Xaa can be any naturally occurring amino acid
  misc_feature (63)..(63): Xaa can be any naturally occurring amino acid
  misc_feature (65)..(65): Xaa can be any naturally occurring amino acid
  misc_feature (92)..(92): Xaa can be any naturally occurring amino acid
  misc_feature (109)..(109): Xaa can be any naturally occurring amino acid
  misc_feature (121)..(121): Xaa can be any naturally occurring amino acid
  misc_feature (130)..(131): Xaa can be any naturally occurring amino acid
  misc_feature (135)..(135): Xaa can be any naturally occurring amino acid
  misc_feature (137)..(138): Xaa can be any naturally occurring amino acid
  misc_feature (141)..(141): Xaa can be any naturally occurring amino acid
  misc_feature (146)..(146): Xaa can be any naturally occurring amino acid
  misc_feature (149)..(149): Xaa can be any naturally occurring amino acid
MEGITNGHAETTFSVTKSXXDPLNWXAAAESSTGSHLDEVKRMXEEYRNPXVKIGGETLTIAXVXGIASHDSGVRVELSEFARAGVKASSDXVMDSMNNGTDSYGVTTXFGATCHRRTKPXWCLAEGAKXXCFEXWXXFGXGSEIXTCXLTT

SEQ ID NO: 276 - DNA, 188 bp, Trifolium repens
  misc_feature (2)..(2): n is a, c, g, or t
  misc_feature (12)..(12): n is a, c, g, or t
  misc_feature (19)..(19): n is a, c, g, or t
  misc_feature (26)..(26): n is a, c, g, or t
  misc_feature (34)..(34): n is a, c, g, or t
  misc_feature (40)..(40): n is a, c, g, or t
  misc_feature (43)..(43): n is a, c, g, or t
  misc_feature (73)..(73): n is a, c, g, or t
  misc_feature (165)..(165): n is a, c, g, or t
  misc_feature (168)..(168): n is a, c, g, or t
  misc_feature (172)..(173): n is a, c, g, or t
  misc_feature (175)..(175): n is a, c, g, or t
  misc_feature (178)..(179): n is a, c, g, or t
  misc_feature (186)..(186): n is a, c, g, or t
  misc_feature (188)..(188): n is a, c, g, or t
cnattgttagtngtttccncccaccnacataacnaatacntanttctctcctctgatcacaattattactttnctacaccctcctctcaactattattaactagcataatggagggaattaccaatggccatgctgaaacaactttttgcgtgaccaaaagtgtnggngatnnantgnnctgtcgngn

SEQ ID NO: 277 - DNA, 541 bp, Trifolium repens
  misc_feature (139)..(139): n is a, c, g, or t
  misc_feature (214)..(214): n is a, c, g, or t
  misc_feature (234)..(234): n is a, c, g, or t
  misc_feature (270)..(271): n is a, c, g, or t
  misc_feature (276)..(276): n is a, c, g, or t
  misc_feature (359)..(359): n is a, c, g, or t
  misc_feature (410)..(410): n is a, c, g, or t
  misc_feature (444)..(444): n is a, c, g, or t
  misc_feature (473)..(474): n is a, c, g, or t
  misc_feature (486)..(486): n is a, c, g, or t
  misc_feature (492)..(492): n is a, c, g, or t
  misc_feature (497)..(497): n is a, c, g, or t
  misc_feature (504)..(505): n is a, c, g, or t
  misc_feature (520)..(520): n is a, c, g, or t
  misc_feature (528)..(528): n is a, c, g, or t
cccataacaaatacattattctctcctctgatcacaattattactttactacaccctcctctcaactattattaactagcataatggagggaattaccaatggccatgctgaaacaacttttatcgtgaccaaaagtgntggtgatccactcaactggggtgcagccgcggagtcgtcgacggggagtcatttggatgaggtgaagcgtatggnggaggagtaccgtaatccgntggttaaaattggcggcgagacgcttaccattgctnnggtanctggaattgcttctcatgatagtggagtgagggtggagctgtccgagttcgcaagggccggcgttaaggcgagtagtgattgngtgatggatagcatgaacaatgggactgatagttacggtgttaccaccgcntttggtgccacctgtcaccggagaaccaagccanggtggtgccttgcagaaggagctaaattnnggtgttttgaangctggnaatantttggcnntggttcagaaatctnaacttgtncacttaccacacc

SEQ ID NO: 278 - DNA, 1185 bp, Trifolium repens
  misc_feature (19)..(19): n is a, c, g, or t
  misc_feature (35)..(35): n is a, c, g, or t
  misc_feature (40)..(40): n is a, c, g, or t
  misc_feature (444)..(444): n is a, c, g, or t
  misc_feature (482)..(483): n is a, c, g, or t
  misc_feature (485)..(485): n is a, c, g, or t
  misc_feature (552)..(552): n is a, c, g, or t
  misc_feature (596)..(596): n is a, c, g, or t
gtaagagttgagaaaaaanaccaataaagtaaacnctatntagaaagagagtcaaaaatggctgaaggaaaaggaagggtttgtgttactggaggaacaggttttcttggttcatggatcatcaagagtcttcttgaaaatggatactctgttaataccactattagagctgatccagaacgtaagagggatgtaagcttcctaacaaatctacccggcgcatccgaaaggctacatttcttcaacgccgatctagacgacccagagagtttcaacgaagcaattgaaggttgtgtcgggatattccacaccgcttcaccaatcgatttcgccgtgagtgagccagaagaaatagtgacaaaaagaacagtggatggagcattaggaattttaaaagcatgtgtgaattcaaagacagtgaagagatttatttacacttcaagnggttctgctgtttcattcaatggaaaaaacaaagatgnntnggatgagagtgattggagtgatgttgatttgcttagaagtgttaaaccatttggttggagttatggngtgttcaagactttggctgagaaagcagtgcttgaatttggtcnacaaaatgggattgatgttgttactttgattcttccttttattgttggaggttttgtttgtcccaagcttcctgattctgttgagaaagctcttgttttggtactaggcaaaaaggaacaaattggtattataagtttccacatggtacatgtagatgatgtggctagagcacatatctatctacttgagaatcctgttccaggaggtagatataattgttcaccattctttgtatctattgaagaaatgtcacagcttctctcagccaaatatccagaatatcaaatactatcagtagatgagttgaaggaaattaaaggggcaagattgccagatttgaactcgaagaagctcgtggacgctggttttgagtttaagtatagtgtcgatgatatgttcgatgatgcgattcaatgctgcaaggaaaaaggctatctctaagcatgtatttgaaaattccatgaagttgagaaaacaataatgtgcctaaaatcaatgatggctaatgagatgtacaagtttatgcattaagttatttgtgatcaatcaaataatgaaataatctgttcatttttccgaaaaaaaaaa

SEQ ID NO: 279 - protein, 326 aa, Trifolium repens
  misc_feature (129)..(129): Xaa can be any naturally occurring amino acid
  misc_feature (142)..(143): Xaa can be any naturally occurring amino acid
  misc_feature (165)..(165): Xaa can be any naturally occurring amino acid
  misc_feature (180)..(180): Xaa can be any naturally occurring amino acid
MAEGKGRVCVTGGTGFLGSWIIKSLLENGYSVNTTIRADPERKRDVSFLTNLPGASERLHFFNADLDDPESFNEAIEGCVGIFHTASPIDFAVSEPEEIVTKRTVDGALGILKACVNSKTVKRFIYTSXGSAVSFNGKNKDXXDESDWSDVDLLRSVKPFGWSYXVFKTLAEKAVLEFGXQNGIDVVTLILPFIVGGFVCPKLPDSVEKALVLVLGKKEQIGIISFHMVHVDDVARAHIYLLENPVPGGRYNCSPFFVSIEEMSQLLSAKYPEYQILSVDELKEIKGARLPDLNSKKLVDAGFEFKYSVDDMFDDAIQCCKEKGYL

SEQ ID NO: 280 - DNA, 493 bp, Trifolium repens
  misc_feature (22)..(22): n is a, c, g, or t
  misc_feature (35)..(35): n is a, c, g, or t
  misc_feature (40)..(40): n is a, c, g, or t
  misc_feature (444)..(444): n is a, c, g, or t
  misc_feature (467)..(467): n is a, c, g, or t
  misc_feature (473)..(473): n is a, c, g, or t
  misc_feature (482)..(483): n is a, c, g, or t
  misc_feature (485)..(487): n is a, c, g, or t
  misc_feature (492)..(492): n is a, c, g, or t
gtagtagttgagaaaaaatacnaataaagtaaacnctatntagaaagagagtcaaaaatggctgaaggaaaaggaagggtttgtgttactggaggaacaggttttcttggttcatggatcatcaagagtcttcttgaaaatggatactctgttaataccactattagagctgatccagaacgtaagagggatgtaagcttcctaacaaatctacccggcgcatccgaaaggctacatttcttcaacgccgatctagacgacccagagagtttcaacgaagcaattgaaggttgtgtcgggatattccacaccgcttcaccaatcgatttcgccgtgagtgagccagaagaaatagtgacaaaaagaacagtggatggagcattaggaattttaaaagcatgtgtgaattcaaagacagtgaagagatttatttacacttcaagnggttctgctgtttcattcaatgnaaaaancaaagatgnntnnnatgana

SEQ ID NO: 281 - DNA, 601 bp, Trifolium repens
  misc_feature (16)..(17): n is a, c, g, or t
  misc_feature (32)..(32): n is a, c, g, or t
  misc_feature (37)..(37): n is a, c, g, or t
  misc_feature (50)..(51): n is a, c, g, or t
  misc_feature (552)..(552): n is a, c, g, or t
agagttgagaaaaaannccaataaagtaaacnctatntagaaagagagtnnaaaatggctgaaggaaaaggaagggtttgtgttactggaggaacaggttttcttggttcatggatcatcaagagtcttcttgaaaatggatactctgttaataccactattagagctgatccagaacgtaagagggatgtaagcttcctaacaaatctacccggcgcatccgaaaggctacatttcttcaacgccgatctagacgacccagagagtttcaacgaagcaattgaaggttgtgtcgggatattccacaccgcttcaccaatcgatttcgccgtgagtgagccagaagaaatagtgacaaaaagaacagtggatggagcattaggaattttaaaagcatgtgtgaattcaaagacagtgaagagatttatttacacttcaagtggttctgctgtttcattcaatggaaaaaacaaagatgttttggatgagagtgattggagtgatgttgatttgcttagaagtgttaaaccatttggttggagttatggtgtnttcaagactttggctgagaaagcagtgcttgaatttggtcaacaaaatg

SEQ ID NO: 282 - DNA, 613 bp, Trifolium repens
  misc_feature (2)..(2): n is a, c, g, or t
  misc_feature (45)..(46): n is a, c, g, or t
gngtgtttaagactttagctgagaaagcagtgcttgaatttggtnnacaaaatgggattgatgttgttactttgattcttccttttattgttggaggttttgtttgtcctaagcttcctgattctgttgagaaagctcttgttttggtactaggcaaaaaggaacaaattggtattataagtttccacatggtacatgtggatgatgtggctagagcacatatctatctacttgagaatcctgttccaggaggtagatataattgttcaccattctttgtatctattgaagaaatgtcacagcttctttcagccaaatatccagaatatcaaatactatctgtagatgagttgaaggaaattaaaggggcaaggttgccagatttgaactcgaagaagctcgtggacgctggttttgagtttaagtatagtgtcgatgatatgttcgatgatgcgattcaatgctgcaaggaaaaaggctatctctaagcatgtgtttgaaaattccatgaagttgagaaaacaatactgtgcctaaaatcaatgatggctaatgagatgtacaagtttatgcattaagttatttgtgatcaatcaaataatgaaataatctg

SEQ ID NO: 283 - DNA, 602 bp, Trifolium repens
  misc_feature (8)..(8): n is a, c, g, or t
  misc_feature (20)..(20): n is a, c, g, or t
  misc_feature (37)..(37): n is a, c, g, or t
agaccttngctgagaaagcngtgcttgaatttggtcnacaaaatgggattgatgttgttactttgattcttccttttattgttggaggttttgtttgtcctaagcttcctgattctgttgagaaagctcttgttttggtactaggcaaaaaggaacaaattggtattataagtttccacatggtacatgtggatgatgtggctagagcacatatctatctacttgagaatcctgttccaggaggtagatataattgttcaccattctttgtatctattgaagaaatgtcacagcttctttcagccaaatatccagaatatcaaatactatctgtagatgagttgaaggaaattaaaggggcaaggttgccagatttgaactcgaagaagctcgtggacgctggttttgagtttaagtatagtgtcgatgatatgttcgatgatgcgattcaatgctgcaaggaaaaaggctatctctaagcatgtgtttgaaaattccatgaagttgagaaaacaatactgtgcctaaaatcaatgatggctaatgagatgtacaagtttatgcattaagttatttgtgatcaatcaaataatgaaataatc

SEQ ID NO: 284 - DNA, 575 bp, Trifolium repens
  misc_feature (1)..(2): n is a, c, g, or t
  misc_feature (13)..(13): n is a, c, g, or t
  misc_feature (15)..(15): n is a, c, g, or t
  misc_feature (56)..(56): n is a, c, g, or t
  misc_feature (575)..(575): n is a, c, g, or t
nnttgaatttggncnacaaaatgggattgatgttgttactttgattcttccttttnttgttggaggttttgtttgtcccaagcttcctgattctgttgagaaagctcttgttttggtactaggcaaaaaggaacaaattggtattataagtttccacatggtacatgtagatgatgtggctagagcacatatctatctacttgagaatcctgttccaggaggtagatataattgttcaccattctttgtatctattgaagaaatgtcacagcttctctcagccaaatatccagaatatcaaatactatcagtagatgagttgaaggaaattaaaggtgcaagattgccagatttgaactcgaagaagctcgtggacgctggttttgagtttaagtatagtgtcgatgatatgtttgatgatgcgattcaatgctgcaaggaaaaaggctatctctaagcatgtatttgaaaattccatgaagttgagaaaacaataatgtgcctaaaatcaatgatggctaatgagatgtacaagtttatgcattaagttatttgtgatcaatcaaataatgaan

SEQ ID NO: 285 - DNA, 604 bp, Trifolium repens
  misc_feature (1)..(2): n is a, c, g, or t
  misc_feature (14)..(15): n is a, c, g, or t
  misc_feature (56)..(56): n is a, c, g, or t
nnttgaatttggtnnacaaaatgggattgatgttgttactttgattcttccttttnttgttggaggttttgtttgtcccaagcttcctgattctgttgagaaagctcttgttttggtactaggcaaaaaggaacaaattggtattataagtttccacatggtacatgtagatgatgtggctagagcacatatctatctacttgagaatcctgttccaggaggtagatataattgttcaccattctttgtatctattgaagaaatgtcacagcttctctcagccaaatatccagaatatcaaatactatcagtagatgagttgaaggaaattaaaggtgcaagattgccagatttgaactcgaagaagctcgtggacgctggttttgagtttaagtatagtgtcgatgatatgtttgatgatgcgattcaatgctgcaaggaaaaaggctatctctaagcatgtatttgaaaattccatgaagttgagaaaacaataatgtgcctaaaatcaatgatggctaatgagatgtacaagtttatgcattaagttatttgtgatcaatcaaataatgaaataatctgttcatttttccgaaaaaaaaaa

SEQ ID NO: 286 - DNA, 695 bp, Lolium perenne
gtsywttcgagtttgagagaatggcttccagggcaaggtgtgtgttactggggcctctggctttgttgcttcttggcttgtcaaaagactactcgagtccggttataatgttctagggacagtcagagacccaggcaatcagaagaaggtagcacacctctggaacttagcaggggccaaggaaaggttggagcttgtcaaagctgacctcttggaagaagggagcttcgatgatgctgtgatggcctgtgagggtgtcttccacactgcatcacctatcatcaccaaatctgataccaaggaagaaatgcttgattctgcaattaacggcactctaaacgtgctgagatcgtgcaagaagaatccttttctcaaaagggttgttctcacgtcatcatcgtcaaccgtgaggctgagggatgaagctgaattcccacccaacgtgttgctggatgaaacatcatggagctccgtggagttctgtgaaagtatccaggtatggtatggtgtcgcgaagatccttgctgagaaatcagcttgggagttcgccaaggagaacaacatcgacctagtggctgttcttccaacgttcgtgattggacctaatctctcgtctgaattaggacccactgttttagatgtccttggcttatttaaaggagagacagagaagttcaccatgtttkggaaggatg

SEQ ID NO: 287 - protein, 231 aa, Lolium perenne
VFSSLREWLPGQVCVTGASGFVASWLVKRLLESGYNVLGTVRDPGNQKKVAHLWNLAGAKERLELVKADLLEEGSFDDAVMACEGVFHTASPIITKSDTKEEMLDSAINGTLNVLRSCKKNPFLKRVVLTSSSSTVRLRDEAEFPPNVLLDETSWSSVEFCESIQVWYGVAKILAEKSAWEFAKENNIDLVAVLPTFVIGPNLSSELGPTVLDVLGLFKGETEKFTMFGKD

SEQ ID NO: 288 - DNA, 667 bp, Lolium perenne
  misc_feature (19)..(19): n is a, c, g, or t
gtttgagagaatggcttcnagggcaggtgtgtgttactggggcctctggctttgttgcttcttggcttgtcaaaagactactcgagtccggttataatgttctagggacagtcagagacccaggcaatcagaagaaggtagcacacctctggaacttagcaggggccaaggaaaggttggagcttgtcaaagctgacctcttggaagaagggagcttcgatgatgctgtgatggcctgtgagggtgtcttccacactgcatcacctatcatcaccaaatctgataccaaggaagaaatgcttgattctgcaattaacggcactctaaacgtgctgagatcgtgcaagaagaatccttttctcaaaagggttgttctcacgtcatcatcgtcaaccgtgaggctgagggatgaagctgaattcccacccaacgtgttgctggatgaaacatcatggagctccgtggagttctgtgaaagtatccaggtatggtatggtgtcgcgaagatccttgctgagaaatcagcttgggagttcgccaaggagaacaacatcgacctagtggctgttcttccaacgttcgtgattggacctaatctctcgtctgaattaggacccactgttttagatgtccttggcttatttaaaggagagacagagaagttcac

SEQ ID NO: 289 - DNA, 688 bp, Lolium perenne
  misc_feature (23)..(23): n is a, c, g, or t
  misc_feature (651)..(651): n is a, c, g, or t
tcgagtttgagagaatggcttcnagggcaggtgtgtgttactggggcctctggctttgttgcttcttggcttgtcaaaagactactcgagtccggttataatgttctagggacagtcagagacccaggcaatcagaagaaggtagcacacctctggaacttagcaggggccaaggaaaggttggagcttgtcaaagctgacctcttggaagaagggagcttcgatgatgctgtgatggcctgtgagggtgtcttccacactgcatcacctatcatcaccaaatctgataccaaggaagaaatgcttgattctgcaattaacggcactctaaacgtgctgagatcgtgcaagaagaatccttttctcaaaagggttgttctcacgtcatcatcgtcaaccgtgaggctgagggatgaagctgaattcccacccaacgtgttgctggatgaaacatcatggagctccgtggagttctgtgaaagtatccaggtatggtatggtgtcgcgaagatccttgctgagaaatcagcttgggagttcgccaaggagaacaacatcgacctagtggctgttcttccaacgttcgtgattggacctaatctctcgtctgaattaggacccactgttttagatgtccttggcttatttaanggagagacagagaagttcaccatgttttggaaggatg

SEQ ID NO: 290 - DNA, 425 bp, Lolium perenne
  misc_feature (3)..(3): n is a, c, g, or t
  misc_feature (62)..(62): n is a, c, g, or t
  misc_feature (321)..(321): n is a, c, g, or t
  misc_feature (332)..(332): n is a, c, g, or t
  misc_feature (344)..(344): n is a, c, g, or t
  misc_feature (352)..(352): n is a, c, g, or t
  misc_feature (360)..(360): n is a, c, g, or t
  misc_feature (363)..(363): n is a, c, g, or t
  misc_feature (387)..(387): n is a, c, g, or t
  misc_feature (390)..(390): n is a, c, g, or t
  misc_feature (396)..(396): n is a, c, g, or t
  misc_feature (404)..(404): n is a, c, g, or t
  misc_feature (409)..(409): n is a, c, g, or t
  misc_feature (423)..(423): n is a, c, g, or t
  misc_feature (425)..(425): n is a, c, g, or t
gtnggcttccagggccggtgtgtgttactggggcctctggctttgttgcttcttggcttgtnaaagactactcgagtccggttataatgttctagggacagtcagagacccaggcaatcagaagaaggtagcacacctctggaacttagcaggggccaaggaaaggttggagcttgtcaaagctgacctcttggaagaagggagcttcgatgatgctgtgatggcctgtgagggtgtcttccacactgcatcacctatcatcaccaaatctgataccaaggaagaaatgcttgattctgcaattaacggcactctaaacgngctgagatcgngcaagaagaatncttttctnaaaagggntgntctcacgtcatcatcgccacccgngangctganggatgaanctganttcccacccaacgngn

SEQ ID NO: 291 - DNA, 691 bp, Lolium perenne
  misc_feature (691)..(691): n is a, c, g, or t
gcattcgagtttgagagaatggcttccagggcaggtgtgtgttactggggcctctggctttgttgcttcctggcttgtcaaaagacttctcgagtccggttataatgttctagggacagtcagagacccaggcaatcagaagaaggtagcacacctctggagcttagcaggggccaaggaaaggctggagcttgtcagagctgacctcttggaagaagggagcttcgatgatgccgtgatggcctgtgagggtgtcttccacactgcatcacctatcatcaccaaatctgataccaaggaagaaatgcttgattctgcaataaacggcactctaaacgtgctgagatcgtgcaagaagaatccttttctcaaaagggttgttctcacgtcatcatcgtcaaccgtgaggctgagggatgaagctgaattcccacccaacgtgttgctggatgaaacatcatggagctccgtggagttctgtgaaagtatccaggtatggtacggtgtcgcaaagatccttgccgagaaatcagcctgggagtttgccaaggagaacaacatcgacctagtggctgttcttccaacattcgtgattggacctaatctctcgtctgaattaggacccactgttttagatgtccttggcttatttaaaggagagacagagaagttcaccatgtttgggaaggan

SEQ ID NO: 292 - DNA, 365 bp, Lolium perenne
  misc_feature (29)..(29): n is a, c, g, or t
  misc_feature (331)..(331): n is a, c, g, or t
  misc_feature (346)..(347): n is a, c, g, or t
  misc_feature (356)..(356): n is a, c, g, or t
  misc_feature (365)..(365): n is a, c, g, or t
gtctttcgagtttgagcagaatggcttcnagggcaggtgtgtgttactggggcctctggctttgttgcttcctggcttgtcaaaagacttctcgagtccggttataatgttctagggacagtcagagacccaggcaatcagaagaaggtagcacacctctggagcttagcaggggccaaggaaaggctggagcttgtcagagctgacctcttggaagaagggagcttcgatgatgccgtgatggcctgtgagggtgtcttccacactgcatcacctatcatcaccaaatctgataccaaggaagaaatgcttgattctgcaataaacggcnctctaaacgtgctgnnatccgggtnaaaaaaaan

SEQ ID NO: 293 - DNA, 524 bp, Lolium perenne
  misc_feature (169)..(169): n is a, c, g, or t
gtcctcgcctacgagcgccccgacgcccgcggccgctacctctgcatcggggccgtgctgcaccgcgcgcacttcctaaagcttctcaaggacctcttcccgcagtactccttcaccgccaagtgcgaagacgacggcaagcccatggcgaagccgtacaagttctccnaccagaggctcagggacctgggattaaaattcactccgctggcggaaagtttgtacgagaccgtgacgtgcctgcaaaaaaatggccacctgcctctgcccgctcccatggcgccaaagcgtgcatacctataatactacaaagacacggccgggatcgacaagccaagaaacagaggattctcccgaggttcaccatggaattgtgtatttcacaaagtttgaattcttattttttttattatgaagaaatacggaaaaccaatactgtataccagaggcaagtgtaacaatgtaaatagtcgtgtaaatcttgttcaagaatgaatgataaagtattttttgcaaaaaaaaaa

SEQ ID NO: 294 - protein, 100 aa, Lolium perenne
  misc_feature (57)..(57): Xaa can be any naturally occurring amino acid
VLAYERPDARGRYLCIGAVLHRAHFLKLLKDLFPQYSFTAKCEDDGKPMAKPYKFSXQRLRDLGLKFTPLAESLYETVTCLQKNGHLPLPAPMAPKRAYL

SEQ ID NO: 295 - DNA, 524 bp, Lolium perenne
  misc_feature (306)..(306): n is a, c, g, or t
  misc_feature (482)..(482): n is a, c, g, or t
  misc_feature (519)..(519): n is a, c, g, or t
gtcctcgcctacgagcgccccgacgcccgcggccgctacctctgcatcggggccgtgctgcaccgcgcgcacttcctaaagcttctcaaggacctcttcccgcagtactccttcaccgccaagtgcgaagacgacggcaagcccatggcgaagccgtacaagttctccaaccagaggctcagggacctgggattaaaattcactccgctggcggaaagtttgtacgagaccgtgacgtgcctgcaaaaaaatggccacctgcctctgcccgctcccgtggcgccaaagcgtgcatacctataatantaccaagacacggccgggatcgacaagccaagaaacagaggattctcccgaggttcaccatggaattgtgtatttcagaaagtttgaattcttattttttttattatgaaggaatacggataaccaatactgtataccagaggcaagtgtaacaatgtaaatagtcgtgtaaatcntgttcaagattgaatgataaagtattttttgcaaaanaaaaa

SEQ ID NO: 296 - DNA, 374 bp, Lolium perenne
  misc_feature (19)..(19): n is a, c, g, or t
  misc_feature (25)..(26): n is a, c, g, or t
aagccgtacaagttctccnaccagnngctcagggacctgggattaaaattcactccgctggcggaaagtttgtacgagaccgtgacgtgcctgcaaaaaaatggccacctgcctctgcccgctcccatggcgccaaagcgtgcatacctataatactacaaagacacggccgggatcgacaagccaagaaacagaggattctcccgaggttcaccatggaattgtgtatttcacaaagtttgaattcttattttttttattatgaagaaatacggaaaaccaatactgtataccagaggcaagtgtaacaatgtaaatagtcgtgtaaatcttgttcaagaatgaatgataaagtattttttgcaaaaaaaaaa

SEQ ID NO: 297 - DNA, 363 bp, Lolium perenne
  misc_feature (7)..(8): n is a, c, g, or t
  misc_feature (363)..(363): n is a, c, g, or t
gttctcnnaccagaggctcagggacctgggattaaaattcactccgctggcggaaagtttgtacgagaccgtgacgtgcctgcaaaaaaatggccacctgcctctgcccgctcccatggcgccaaagcgtgcatacctataatactacaaagacacggccgggatcgacaagccaagaaacagaggattctcccgaggttcaccatggaattgtgtatttcacaaagtttgaattcttattttttttattatgaagaaatacggaaaaccaatactgtataccagaggcaagtgtaacaatgtaaatagtcgtgtaaatcttgttcaagaatgaatgataaagtattttttgcaaaaaaaaan

SEQ ID NO: 298 - DNA, 1381 bp, Lolium perenne
  misc_feature (5)..(5): n is a, c, g, or t
  misc_feature (1280)..(1280): n is a, c, g, or t
  misc_feature (1338)..(1338): n is a, c, g, or t
tctcnagacacactgtgtaaccacggtagcgagtggcaagactagcagaaagtacggacatcagctaaccattcctcaactagaataagcatggctccggcgatgtccaaccctctcctcagtgatcgggtggcacgctccaagaaagtcccatctagccacgttagagcggtgggagaccgcccagacctcgccaatgtcgaccacgagtccggcgcgggcattccgctcatcgacctgaagcagctcgaaggtccagggcgccgcagggtcgtcgaggccatcggctccgcgtgcgagaacgatgggtttttcatggtgacgaatcatggcatcccagaggcggtcgtggaggggatgctgagcgtggcgagggagttcttccacctgccggagtcggagcggctcaagtgctactccgacgaccccaagaaggcggtccggctgtcgacgagcttcaacgtgcgcacggagaaggtgagcaactggcgcgacttcctccggctgcattgctaccctcttgagagcttcgtcgaccagtggccgtcgaacccgcccgccttcaggcaagtcgtcggcacctactcgacggaagcgagagcgctggcgctgaggctcctggaggcgatatcggagagcctagggctggagagaggccacatggtgaaggccatggggcggcacgcgcagcacatggcggtgaactactacccgccgtgcccgcagccggagctcacctacggtctgccagggcacacggaccccaacgccctcaccatcctcctcatggatccccacgtctccggcctccaggtcctcagggacggcgccaagtggatcgccgtccacccacgccccaacgccctggtcatcaacctaggcgaccagctacaggcgctgagcaacggcgcgtacaagagcgtgtggcaccgggcagtggtgaacgcggagcaggagcgtctgtcggtggcatctttcctgtgcccgtgcaacagcgcggttatctgccccgcgccgaggctcgtcggcgacggggaggaccccgtctaccggagctacacctacgacgagtactacaagaggttttggagcaggaacctggatcaggagcactgcctcgagctcttcaggagtcagcactgatgcttgaaccttgagttactagctagctctccttaacagtgcaaatccatggcccaagagggccccgattgcatggttacttatgttgtttgaactggtattgcttaagtgcctaataacattgctacattctactnctatcttgtccgtttaaaattataagatggcctaacctttttcttaattgtatgcatnctgaacatatttaagtgtgtgtgttcagacagtttagtctgca

SEQ ID NO: 299 - protein, 346 aa, Lolium perenne
MSNPLLSDRVARSKKVPSSHVRAVGDRPDLANVDHESGAGIPLIDLKQLEGPGRRRVVEAIGSACENDGFFMVTNHGIPEAVVEGMLSVAREFFHLPESERLKCYSDDPKKAVRLSTSFNVRTEKVSNWRDFLRLHCYPLESFVDQWPSNPPAFRQVVGTYSTEARALALRLLEAISESLGLERGHMVKAMGRHAQHMAVNYYPPCPQPELTYGLPGHTDPNALTILLMDPHVSGLQVLRDGAKWIAVHPRPNALVINLGDQLQALSNGAYKSVWHRAVVNAEQERLSVASFLCPCNSAVICPAPRLVGDGEDPVYRSYTYDEYYKRFWSRNLDQEHCLELFRSQH

SEQ ID NO: 300 - DNA, 755 bp, Lolium perenne
  misc_feature (5)..(5): n is a, c, g, or t
tctcnagacacactgtgtaaccacggtagcgagtggcaagactagcagaaagtacggacatcagctaaccattcctcaactagaataagcatggctccggcgatgtccaaccctctcctcagtgatcgggtggcacgctccaagaaagtcccatctagccacgttagagcggtgggagaccgcccagacctcgccaatgtcgaccacgagtccggcgcgggcattccgctcatcgacctgaagcagctcgaaggtccagggcgccgcagggtcgtcgaggccatcggctccgcgtgcgagaacgatgggtttttcatggtgacgaatcatggcatcccagaggcggtcgtggaggggatgctgagcgtggcgagggagttcttccacctgccggagtcggagcggctcaagtgctactccgacgaccccaagaaggcggtccggctgtcgacgagcttcaacgtgcgcacggagaaggtgagcaactggcgcgacttcctccggctgcattgctaccctcttgagagcttcgtcgaccagtggccgtcgaacccgcccgccttcaggcaagtcgtcggcacctactcgacggaagcgagagcgctggcgctgaggctcctggaggcgatatcggagagcctagggctggagagaggccacatggtgaaggccatggggcggcacgcgcagcacatggcggtgaactactacccgccgtgcccgcagccggagctcacctacggtctgccagggca

SEQ ID NO: 301 - DNA, 780 bp, Lolium perenne
  misc_feature (21)..(21): n is a, c, g, or t
  misc_feature (778)..(778): n is a, c, g, or t
tctagacacactgtgtaaccncggtagcgagtggcaagactagcagaaagtacggacatcagctaaccattcctcaactagaataagcatggctccggcgatgtccaaccctctcctcagtgatcgggtggcacgctccaagaaagtcccatctagccacgttagagcggtgggagaccgcccagacctcgccaatgtcgaccacgagtccggcgcgggcattccgctcatcgacctgaagcagctcgaaggtccagggcgccgcagggtcgtcgaggccatcggctccgcgtgcgagaacgatgggtttttcatggtgacgaatcatggcatcccagaggcggtcgtggaggggatgctgagcgtggcgagggagttcttccacctgccggagtcggagcggctcaagtgctactccgacgaccccaagaaggcggtccggctgtcgacgagcttcaacgtgcgcacggagaaggtgagcaactggcgcgacttcctccggctgcattgctaccctcttgagagcttcgtcgaccagtggccgtcgaacccgcccgccttcaggcaagtcgtcggcacctactcgacggaagcgagagcgctggcgctgaggctcctggaggcgatatcggagagcctagggctggagagaggccacatggtgaaggccatggggcggcacgcgcagcacatggcggtgaactactacccgccgtgcccgcagccggagctcacctacggtctgccagggcacacggaccccaatgccctcaccatnct

SEQ ID NO: 302 - DNA, 793 bp, Lolium perenne
  misc_feature (64)..(64): n is a, c, g, or t
  misc_feature (692)..(692): n is a, c, g, or t
  misc_feature (750)..(750): n is a, c, g, or t
ggggaagtccggctgctggggcttcggcttctgggcgcgatctcgctggggctggggctggagngagggtatgtggagaaggtgctgggcgagcaggagcagcacatggccgtgaactactacccgcggtgccccgagccggacctcacctacggcctgcccaagcacacggaccccaacgccctcaccatcctcctcatggatccccacgtctccggcctccaggtcctcagggacggcgccaagtggatcgccgtccacccacgccccaacgccctggtcatcaacctaggcgaccagctacaggcgctgagcaacggcgcgtacaagagcgtgtggcaccgggcagtggtgaacgcggagcaggagcgtctgtcggtggcatctttcctgtgcccgtgcaacagcgcggttatctgccccgcgccgaggctcgtcggcgacggggaggaccccgtctaccggagctacacctacgacgagtactacaagaggttttggagcaggaacctggatcaggagcactgcctcgagctcttcaggagtcagcactgatgcttgaaccttgagttactagctagctctccttaacagtgcaaatccatggcccaagagggccccgattgcatggttacttatgttgtttgaactggtattgcttaagtgcctaataacattgctacattctactnctatcttgtccgtttaaaattataagatggcctaacctttttcttaattgtatgcatnctgaacatatttaagtgtgtgtgttcagacagtttagtctgca

SEQ ID NO: 303 - DNA, 1395 bp, Lolium perenne
gaattcgattaagcagtggtaacaacgcagagtacgcggggactctcagaacacactgtgtaaccacggtagcgagtggcaagactagcagaaagtacggacatcagctaaccattcctcaactagaataagcatggctccggcgatgtccaaccctctcctcagtgatcgggtggcacgctccaagaaagtcccatctagccacgttagagcggtgggagaccgcccagacctcgccaatgtcgaccacgagtccggcgcgggcattccgctcatcgacctgaagcagctcgaaggtccagggcgccgcagggtcgtcgaggccatcggctccgcgtgcgagaacgatgggtttttcatggtgacgaatcatggcatcccagaggcggtcgtggaggggatgctgagcgtggcgagggagttcttccacctgccggagtcggagcggctcaagtgctactccgacgaccccaagaaggcggtccggctgtcgacgagcttcaacgtgcgcacggagaaggtgagcaactggcgcgacttcctccggctgcattgctaccctcttgagagcttcgtcgaccagtggccgtcgaacccgcccgccttcaggcaagtcgtcggcacctactcgacggaagcgagagcgctggcgctgaggctcctggaggcgatatcggagagcctagggctggagagaggccacatggtgaaggccatggggcggcacgcgcagcacatggcggtgaactactacccgccgtgcccgcagccggagctcacctacggtctgccagggcacaaggaccccaatgccatcacgctcctcctgcaggacggcgtctccggcctgcaggtccagcgcgacggccggtgggtggccgtcaacccggtgcccaacgccctcgtcatcaacatcggcgatcagttacaggcgctgagcaacgaccgatacaagagcgtgaaccacagagtgatcgtcaacagcgcgagcgagaggatttcggtgccgacgttctactgcccgtcgccggacacggtggtcgcgccggccgacgcgctggtggacgacgcccaccctcgggcctaccagcccttcacgtaccaggagtactacgaggagttctggaagatgggccttcagtcagcaagttgcctcgacaggttccgacggatcgagtgatggacaagacgtgggccgttgttatctcctgggccatgagcgttgccgcagccgatgtgtcgccatatggtggagacgtttcctccctccggaaaagaaaaataaaacagagtggagaccactagaaccgtcagatagcatcccaaaaaaaaaaaaaaaaaaaaaaaaaaaaaagtactctgcgttgttaccactgcttaatcactagtgaattc

SEQ ID NO: 304 - protein, 348 aa, Lolium perenne
MAPAMSNPLLSDRVARSKKVPSSHVRAVGDRPDLANVDHESGAGIPLIDLKQLEGPGRRRVVEAIGSACENDGFFMVTNHGIPEAVVEGMLSVAREFFHLPESERLKCYSDDPKKAVRLSTSFNVRTEKVSNWRDFLRLHCYPLESFVDQWPSNPPAFRQVVGTYSTEARALALRLLEAISESLGLERGHMVKAMGRHAQHMAVNYYPPCPQPELTYGLPGHKDPNAITLLLQDGVSGLQVQRDGRWVAVNPVPNALVINIGDQLQALSNDRYKSVNHRVIVNSASERISVPTFYCPSPDTVVAPADALVDDAHPRAYQPFTYQEYYEEFWKMGLQSASCLDRFRRIE

SEQ ID NO: 305 - DNA, 1309 bp, Trifolium repens
gaattcgattaagcagtggtaacaacgcagagtacgcgggataaaaactgcactagtgtgtataagtttcttggtgaaaaaagagtttgtaaattaacatcatggctagtatcaaacaaattggaaacaagaaagcatgtgtgattggtggcactggttttgttgcatctatgttgatcaagcagttacttgaaaagggttatgctgttaatactaccgttagagacccagatagccctaagaaaatatctcacctagtggcactgcaaagtttgggggaactgaatctatttagagcagacttaacagttgaagaagattttgatgctcctatagcaggatgtgaacttgtttttcaacttgctacacctgtgaactttgcttctcaagatcctgagaatgacatgataaagccagcaatcaaaggtgtgttgaatgtgttgaaagcaattgcaagagcaaaagaagttaaaagagttatcttaacatcttcggcagccgcggtgactataaatgaactcaaagggacaggtcatgttatggatgaaaccaactggtctgatgttgaatttctcaacactgcaaaaccacccacttggggttatcctgcctcaaaaatgctagctgaaaaggctgcatggaaatttgctgaagaaaatgacattgatctaatcactgtgatacctagtttaacaactggtccttctctcacaccagatatcccatctagtgttggcttggcaatgtctctaataacaggcaatgattttctcataaatgctttgaaaggaatgcagtttctgtcgggttcgttatccatcactcatgttgaggatatttgccgagctcatatatttcttgcagagaaagaatcagcttctggtagatacatttgctgtgctcacaatactagtgttcccgagcttgcaaagtttctcaacaaacgatatcctcagtataaagttccaactgaatttgatgattgccccagcaaggcaaagttgataatctcttctgaaaagcttatcaaagaagggttcagtttcaagcatggtattgccgaaactttcgaccagactgtcgagtattttaagactaagggggcactgaagaattagattttgatatttctaattcaatagcaaactctaagcttgttatgtgtttgtgaagttcagagtgaaatatcaaatgaataagtggagagagcacaataagaggagagcacaataattttggaaaaaaaaaaaaaaaaaaaaaaaaaaaaagtactctgcgttgttaccactgcttaatcactagtgaattc

SEQ ID NO: 306 - protein, 338 aa, Trifolium repens
MASIKQIGNKKACVIGGTGFVASMLIKQLLEKGYAVNTTVRDPDSPKKISHLVALQSLGELNLFRADLTVEEDFDAPIAGCELVFQLATPVNFASQDPENDMIKPAIKGVLNVLKAIARAKEVKRVILTSSAAAVTINELKGTGHVMDETNWSDVEFLNTAKPPTWGYPASKMLAEKAAWKFAEENDIDLITVIPSLTTGPSLTPDIPSSVGLAMSLITGNDFLINALKGMQFLSGSLSITHVEDICRAHIFLAEKESASGRYICCAHNTSVPELAKFLNKRYPQYKVPTEFDDCPSKAKLIISSEKLIKEGFSFKHGIAETFDQTVEYFKTKGALKN

SEQ ID NO: 307 - DNA, 1005 bp, Trifolium repens
gaattcgattaagcagtggtaacaacgcagagtacgcggggacttaaacattgacacaagtcccaaataaaaaagatctgaaacaacatagtcaccccattttttaacattaaactaaaaatatgtcggccatcaccgcaatccaagtcgagaaccttgaatttccggctgtggttacttctccggccaccggtaagtcatattttcttggtggtgcaggggagagaggtttgactattgaaggaaacttcatcaagttcactgccataggagtatatttggaagatgtagcagtggcttcacttgccactaaatggaagggtaaatcctctgaggagttgcttgagactcttgacttctatagagacatcatttcaggaccctttgaaaagttgattcgaggatcgaagattagggaattgagtggtcctgagtactcaaggaaggttaatgaaaactgcgtggcacacttaaaatctgttgggacttatggagatgctgaagctgaagctatgcaaaaatttgttgaagccttcaagcctattaattttccacctggtgcctctgttttttacaggcaatcacctgatggaatattagggcttagtttctctcaagatgcaagtataccagaaaaggaggctgcagtaatagagaacaaggcagcttcatcggcagtgttagaaactatgattggtgaacatgctgtttctcctgatttaaagcgttgtttggctgcaagattacctgccttgttgaacgagggtactttcaagattgaatgaaaactgattattattatctccaaaagcattgcagcacaagattgagtcatttatgagcatggacatttttatgtccacacatgtttaacttttgtatctctctttagattctcatcaatatcaataatactaatatgaaacgaagtcaaaaaaaaaaaaaaaaaaaaaaaaaaaaaaaagtactctgcgttgttaccactgcttaatcactagtgaattc

SEQ ID NO: 308 - protein, 220 aa, Trifolium repens
MSAITAIQVENLEFPAVVTSPATGKSYFLGGAGERGLTIEGNFIKFTAIGVYLEDVAVASLATKWKGKSSEELLETLDFYRDIISGPFEKLIRGSKIRELSGPEYSRKVNENCVAHLKSVGTYGDAEAEAMQKFVEAFKPINFPPGASVFYRQSPDGILGLSFSQDASIPEKEAAVIENKAASSAVLETMIGEHAVSPDLKRCLAARLPALLNEGTFKIE

SEQ ID NO: 309 - DNA, 1105 bp, Trifolium repens
gaattcactagtgattaagcagtggtaacaacgcagagtacgcggggacattacaactcacaacaccttctccattaccatctatcttctactaagttcaacgagatcaatggcacttccttctgtcaccgctttgaatatcgagaacaatctattccctcctaccgtcacaccaccgggatccaccaacaatttcttcctcggcggtgcaggagagcggggtcttcaaattcaagacaaatttgtcaaattcaccgctattggtgtttatctacaggacattgctgttccttacctcgccactaaatggaagggtaagactgctcaagagctaacggaaactgttcctttcttcagggacatcgttacaggtccatttgagaaatttatgcaggtgacaatgatcttgccattgactgggcaacaatactcagagaaagtgtcagaaaattgtgtagctatttggaagtctcttgggatttataccgacgaagaagccaaagcaattgagaagtttgtttctgtcttcaaagatgaaacattcccaccaggctcctctatccttttcacagtattacccaaaggattaggatcactaacgataagtttctctaaagatggatccattccagagaccgagtctgcagttatagagaataagctactctcacaagctgtgcttgagtcgatgataggggcgcacggtgtctcccctgcagcaaaacagagtttggccaccaggttatccgagttattcaacgaggttggtgatgctagcaactgattatatcaacaaaacgaaaatgaaagtcctttctgcaataaagaccaagcggaaattttattttaggtgcactttgaaatgacctctttggcgactttttcttgtactaataataaagagtgtgtttgtatcatgttgtaattttattttagaaaaagtgaggtaagaaaggagtccttatgtttatttcaattattgaaaaattatttgcatgtataattgatttcaactgatgttatttaatcacgttttttctaaaaaaaaaaaaaaaaaaaaaaaaaaaaaagtactctgcgttgttaccactgcttaatcgaattc

SEQ ID NO: 310 - protein, 224 aa, Trifolium repens
MALPSVTALNIENNLFPPTVTPPGSTNNFFLGGAGERGLQIQDKFVKFTAIGVYLQDIAVPYLATKWKGKTAQELTETVPFFRDIVTGPFEKFMQVTMILPLTGQQYSEKVSENCVAIWKSLGIYTDEEAKAIEKFVSVFKDETFPPGSSILFTVLPKGLGSLTISFSKDGSIPETESAVIENKLLSQAVLESMIGAHGVSPAAKQSLATRLSELFNEVGDASN

SEQ ID NO: 311 - DNA, 1272 bp, Trifolium repens
gaattcgattaagcagtggtaacaacgcagagtacgcggggattcaaacatagctcaaagtgtgtaacaaatttcttaacttaaaacattttcaacccaacaaaaaaaaacaaagacaaaaacatgggtagtgttgaaattccaacaaaggttcttactaacagttctagtcaagtgaaaatgcctgtggttggaatgggatcagcacctgatttcacatgtaagaaagacacaaaagatgcaatcattgaagccatcaaacagggttatagacactttgatactgctgctgcttatggctcagaacaagctcttggtgaaggtttgaaagaagcaattgaacttggtcttgtcactagagaagacctttttgttacttctaaactttgggtcactgaaaatcatcctcatcttgttgttcctgctcttcaaaaatctctcaagactcttcaattggagtacttggacttgtatttgatccattggccacttagttctcagcctggaaagttttcatttccaattgatgtggcagatctcttgccatttgatgtgaagggtgtttgggaatccatggaagaaggcttgaaacttggactcactaaagctattggtgttagtaacttctctgtcaagaaacttcaaaatcttgtctcagttgccactgttcttcctgctgtcaatcaagtggagatgaaccttgcatggcaacaaaagaagcttagagaattttgcaatgcaaatggaatagtgttaactgcattttcaccattgagaaaaggtgcaagcaggggaccaaatgaagttatggaaaatgatatgcttaaagagattgcagatgctcatggaaagtctgttgcacaaatttcattgagatggttatatgaacaaggagtcacttttgttcccaagagctatgataaggaaagaatgggtcaaaatttggctatctttgattggacattggcaaaagaagatcatgagaaaattgatcaaattaagcagaaccgtttgatccctggaccaaccaagccaggactcagtgacctatgggatgatgaaatataaagtggaagatgttaaaagtcccttaagctcactcaatatctatctattgtgtactttttgcatttggggtttgaaattgagtcacccttgtttctgtatcgatttaaaatttaaataatcaatttttcattacaaaaaaaaaaaaaaaaaaaaaaaaaaaaaagtactctgcgttgttaccactgcttaatcactagtgaattc

SEQ ID NO: 312 - protein, 314 aa, Trifolium repens
MGSVEIPTKVLTNSSSQVKMPVVGMGSAPDFTCKKDTKDAIIEAIKQGYRHFDTAAAYGSEQALGEGLKEAIELGLVTREDLFVTSKLWVTENHPHLVVPALQKSLKTLQLEYLDLYLIHWPLSSQPGKFSFPIDVADLLPFDVKGVWESMEEGLKLGLTKAIGVSNFSVKKLQNLVSVATVLPAVNQVEMNLAWQQKKLREFCNANGIVLTAFSPLRKGASRGPNEVMENDMLKEIADAHGKSVAQISLRWLYEQGVTFVPKSYDKERMGQNLAIFDWTLAKEDHEKIDQIKQNRLIPGPTKPGLSDLWDDEI

SEQ ID NO: 313 - DNA, 1548 bp, Trifolium repens
gaattcgattaagcagtggtatcaacgcagagtacgcggggacaacaactataacttcctgttattaaccaattgagttcaaattacatacatagcaggaactatactaaagatatcaacatggttagtgtttctgaaattcgcaaggctcaaagggctgaaggccctgcaactattttggccattggtactgcaaatccagcaaatcgtgttgaccagagtacatatcctgatttctacttcaaaatcactaacagtgagcataaggttgagcttaaagagaaatttcagcgcatgtgtgataaatctatgatcaagagcagatacatgtatctaacagaagagattttgaaagaaaatcctagtctttgtgaatacatggcaccttcattggatgctaggcaagacatggtggtggttgaggtacctagacttgggaaggaggctgcagtgaaagctatcaaagaatggggtcaaccaaagtcaaagattactcacttaatcttttgcaccacaagtggtgttgacatgcctggtgccgattaccaactcacaaaactcttaggtcttcgcccatatgtgaagaggtacatgatgtaccaacaagggtgctttgcaggtgggacggttcttcgtttggccaaggatttggccgagaacaacaaaggtgctcgtgtgttggttgtttgctctgaagtaaccgcagtcacattccgcggccccagtgacactcatttggacagtcttgttggacaagcactattcggagatggagctgctgcactcattgttggctcagacccagtaccagaaattgagaagccaatatttgagatggtttggaccgcacagacaattgctccagatagtgaaggtgccattgatggtcatcttcgtgaagctggactaacatttcatcttcttaaagatgttcctgggattgtctcaaagaacattgataaggcattggttgaggcattccaaccattaaacatctctgattacaattcaatcttttggattgctcatccaggtggtcctgcaattctagaccaagttgagataaagttgggcttaaaacctgaaaaaatgaaggccaccagagatgtacttagtgaatatggtaacatgtcaagtgcatgtgtattgttcatcttagatgagatgagaaagaaatcggctgaaaatggacttaaaaccacaggagaaggacttgactggggtgtgttgtttggatttgggcccggacttaccattgaaactgttgttctacatagtgtggctatatgagaatgagagacttgatttgtttttattgtattgtattgtattactttaaatcttggttgaacctccattttaagaataaatatggagttcaatatggaccatcctgttaaaataatatatcgttaatagctattattttagtgtctgtttctttttactaaactattttattttagtatttgtttttgaccaaaaaaaaaaaaaaaaaaaaaaaaaagtactctgcgttgttaccactgcttaatcactagtgaattc

SEQ ID NO: 314 - protein, 389 aa, Trifolium repens
MVSVSEIRKAQRAEGPATILAIGTANPANRVDQSTYPDFYFKITNSEHKVELKEKFQRMCDKSMIKSRYMYLTEEILKENPSLCEYMAPSLDARQDMVVVEVPRLGKEAAVKAIKEWGQPKSKITHLIFCTTSGVDMPGADYQLTKLLGLRPYVKRYMMYQQGCFAGGTVLRLAKDLAENNKGARVLVVCSEVTAVTFRGPSDTHLDSLVGQALFGDGAAALIVGSDPVPEIEKPIFEMVWTAQTIAPDSEGAIDGHLREAGLTFHLLKDVPGIVSKNIDKALVEAFQPLNISDYNSIFWIAHPGGPAILDQVEIKLGLKPEKMKATRDVLSEYGNMSSACVLFILDEMRKKSAENGLKTTGEGLDWGVLFGFGPGLTIETVVLHSVAI

SEQ ID NO: 315 - DNA, 1447 bp, Trifolium repens
gaattcactagtgattaagcagtggtaacaacgcagagtacgcggggaacaaaaacaactacgcatattatatatatatatatatagtctataattgaaagaaactgctaaagatattattaagatatggtgagtgtagctgaaattcgcaaggctcagagggctgaaggccctgcaaccattttggccattggcactgcaaatccaccaaaccgtgttgagcagagcacatatcctgatttctacttcaaaattacaaacagtgagcacaagactgagctcaaagagaagttccaacgcatgtgtgacaaatccatgatcaagagcagatacatgtatctaacagaagagattttgaaagaaaatcctagtctttgtgaatacatggcaccttcattggatgctaggcaagacatggtggtggttgaggtacctagacttgggaaggaggctgcagtcaaggccattaaagaatggggtcaaccaaagtcaaagattactcacttaatcttttgcaccacaagtggtgttgacatgcctggtgctgattaccaactcacaaaactcttaggtcttcgcccatatgtgaaaaggtatatgatgtaccaacaaggttgttttgcaggaggcacggtgcttcgtttggcaaaagatttggccgagaacaacaaaggtgctcgtgtgctagttgtttgttctgaagtcaccgcagtcacatttcgcggccccagtgatactcacttggacagtcttgttggacaagcattgtttggagatggagccgctgcactaattgttggttctgatccagtgcctgaaattgagaaaccaatatttgagatggtttggactgcacaaacaattgctccagacagtgaaggtgccattgatggtcatcttcgtgaagctgggctaacatttcatcttcttaaagatgttcctgggattgtatcaaagaacattaataaagcattggttgaggctttccaaccattaggaatttctgactacaactcaatcttttggattgcacacccgggtggacctgcaattcttgatcaagtagaacaaaagctagccttgaagcccgaaaagatgagggccacgagggaagttctaagtgaatatggaaacatgtcaagcgcatgtgtattgttcatcttagatgagatgcggaagaaatcggctcaaaatggacttaagacaactggagaaggacttgattggggtgtgttgttcggcttcggaccaggacttaccattgaaaccgttgttcttcgtagcgtggctatataagatgtgtgattgtttttattttaatgtattacttttaatcttgctgccttgaatttcgatttaagaataaataaatatatcttttgataaaaaaaaaaaaaaaaaaaaaaaaaaaagtactctgcgttgttaccactgcttaatcgaattc

SEQ ID NO: 316 - protein, 389 aa, Trifolium repens
MVSVAEIRKAQRAEGPATILAIGTANPPNRVEQSTYPDFYFKITNSEHKTELKEKFQRMCDKSMIKSRYMYLTEEILKENPSLCEYMAPSLDARQDMVVVEVPRLGKEAAVKAIKEWGQPKSKITHLIFCTTSGVDMPGADYQLTKLLGLRPYVKRYMMYQQGCFAGGTVLRLAKDLAENNKGARVLVVCSEVTAVTFRGPSDTHLDSLVGQALFGDGAAALIVGSDPVPEIEKPIFEMVWTAQTIAPDSEGAIDGHLREAGLTFHLLKDVPGIVSKNINKALVEAFQPLGISDYNSIFWIAHPGGPAILDQVEQKLALKPEKMRATREVLSEYGNMSSACVLFILDEMRKKSAQNGLKTTGEGLDWGVLFGFGPGLTIETVVLRSVAI

SEQ ID NO: 317 - DNA, 2394 bp, Trifolium repens
gaattcgattaagcagtggtaacaacgcagagtacgcggggattcaatctgttgtgcataaaattcactcattgcatagaaaaccatacacatttgatcttgcaaagaagaaatatgggagacgaaggtatagtgagaggtgtcacaaagcagacaacccctgggaaggctactatattggctcttggcaaggcattccctcaccaacttgtgatgcaagagtgtttagttgatggttattttagggacactaattgtgacaatcctgaacttaagcagaaacttgctagactttgtaagacaaccacggtaaaaacaaggtatgttgttatgaatgaggagatactaaagaaatatccagaacttgttgtcgaaggcgcctcaactgtaaaacaacgtttagagatatgtaatgaggcagtaacacaaatggcaattgaagcttcccaagtttgcctaaagaattggggtagatccttatcggacataactcatgtggtttatgtttcatctagtgaagctagattacccggtggtgacctatacttgtcaaaaggactaggactaaaccctaaaattcaaagaaccatgctctatttctctggatgctcgggaggcgtagccggccttcgcgttgcgaaagacgtagctgagaacaaccctggaagtagagttttgcttgctacttcggaaactacaattattggattcaagccaccaagtgttgatagaccttatgatcttgttggtgtggcactctttggagatggtgctggtgcaatgataattggctcagacccggtatttgaaactgagacaccattgtttgagctgcatacttcagctcaggagtttataccagacaccgagaagaaaattgatgggcggctgacggaggagggcataagtttcacactagcaagggaacttccgcagataatcgaagacaatgttgagggattctgtaataaactaattgatgttgttgggttggagaataaggagtacaataagttgttttgggctgtgcatccaggtgggcctgcgatattgaatcgcgtggagaagcggcttgagttgtcgccgcagaagctgaatgctagtagaaaagctctaatggattatggaaatgctagcagcaatactattgtttatgtgctggaatatatgctagaagaggaaaagaagattaaaaaggcgggtggaggagattctgaatggggattgatacttgcttttggacctggaattacttttgaggggattctagcaaggaacttgtgtgcatgaagtcttatacaattgtgatgcatgacttatactcttatttctactaattattatattaagcaaattcagaacttttaagtaatgatttaatgaagaatacttatagtatattgactttattcactttcaaagcaagtttatgatcctaagacatggtagaacttgagcatgtggaatagttgtaacaaaaactctaagcaaatagagactttatgtagtataaagcatttccagacatgataaataatggtacctcagaacataaaatatatttagctatctttcatccccaactttacacatccaccaaggtacagaataagcatatgtcaacacaaaatgtactctaagtctaacatgagtaaccaaacatgatgcctgattaagttaaaagaaaagaaaatctgagggcatagatcttcaatcacaccactccagagggaaggcgtagaacaagctgtccgccgaaaacactgcaattcaataaatatcattaggacaacagtgcagagtcatgcgggaaatgtcttaagtcactgtactaaaaatataggattatattatgaactatactaaccttttcacataatagtaacagaaatcagctaagatgaatgtctggacaatttctgagataagaaccatgacggccataagccataccccaaggcaaccaataaatgtccacgggtatctaacacctgttgcaagaaatagtaagttattaggagatgtgcggttacgaaattcaagctacacaacaaaaggaggccagaacaacagcaatcttgtaaccagatgacaacaataaaatgtaaacttaaagagaccgaacacacaaacattgcaactcagatggaattgctgccatgtaactagtaggagatttgggacgtcaaatcagtatattatgcaaatacaaggtatgaccgccttgtctattgtagcatacaacaaacgtacagtgggtttgtccctctcaaaatggcaggatctttacagcacaatatttggttttgtcatacttataccataaaaaaaaaaaaaaaaaaaaaaaaaaaaagtactctgcgttgttaccactgcttaatcactagtgaattc

SEQ ID NO: 318 - protein, 391 aa, Trifolium repens
MGDEGIVRGVTKQTTPGKATILALGKAFPHQLVMQECLVDGYFRDTNCDNPELKQKLARLCKTTTVKTRYVVMNEEILKKYPELVVEGASTVKQRLEICNEAVTQMAIEASQVCLKNWGRSLSDITHVVYVSSSEARLPGGDLYLSKGLGLNPKIQRTMLYFSGCSGGVAGLRVAKDVAENNPGSRVLLATSETTIIGFKPPSVDRPYDLVGVALFGDGAGAMIIGSDPVFETETPLFELHTSAQEFIPDTEKKIDGRLTEEGISFTLARELPQIIEDNVEGFCNKLIDVVGLENKEYNKLFWAVHPGGPAILNRVEKRLELSPQKLNASRKALMDYGNASSNTIVYVLEYMLEEEKKIKKAGGGDSEWGLILAFGPGITFEGILARNLCA

SEQ ID NO: 319 - DNA, 1663 bp, Trifolium repens
gaattcgattaagcagtggtaacaacgcagagtacgcggggatagcaacacacactttgatttctttttgagtccttgctacgtggctttaccaaaaaacgttgctaagtcatcaaccattccaattccttaatataacctatcagtactcaccatcttttcttcctccctgctaactttagactcagagaagatggtgaatgttaatgagatccgccaggcacagagagctgaaggccctgccaccgtgttggcaatcggcactgcaactcctccaaactgtgtcgatcagagtacatacccagactactacttccgcatcacaaacagtgagcacaagacagagctcaaagaaaaattccagcgcatgtgtgacaaatctatgattaagaagagatacatgcatttgacagaagagattttgaaggagaatccaagtttatgtgagtacatggcaccttcattggatgcaagacaagacatggtggttgtggaagtaccaaggctaggaaaagaggctgcaacaaaggctatcaaggaatggggtcaacctaagtccaagattactcacctcatcttttgcaccacaagtggtgtggacatgcctggcgccgactatcagcttacaaagcttttaggccttcgtccgcatgtgaagcgttatatgatgtaccaacaaggttgtttcgctggtggtacggtgcttcgtttggctaaagacttggctgaaaacaacaaaggtgcccgtgtgttggtggtttgttcagagatcactgcggttactttccgtggacccagtgacactcatcttgatagccttgtggggcaagcattgtttggagatggtgcagcagctgtgattgtaggttcagacccattaccacaagttgagaagcccttgtttgaattggtatggactgctcaaacaatccttccagacagtgaaggagccattgatgggcaccttcgtgaagtcgggctgacattccatctcctcaaggatgttcctggactcatctcaaagaacattgagaaagctcttgttgaggcctttcaacctttaggtatctctgattacaattctatattttggatcgcacatcctggtggacctgcaattctggaccaagtggaagccaaattaagcttaaagccagagaaaatgcaagccacccggcatgtgcttagcgagtatggtaacatgtcaagtgcatgtgtgttatttatcttggatgagatgaggaggaagtcaaaagaagatggacttgccacaacaggcgaggggctggaatggggtgtactattcggttttggacccggactcactgttgagactgtattgctccatagtgttgccacttaaattgcctagatatgctataactatatgcttatttaattctttgtttctgggggattttatcttcacttacttcactgagcatttgaataaagtttgttttaattattcataatgtaatatggtgttgcttaatgtacccatccatataatatttgtaatacatatattaatcaacttgcaatttcatgaaaaaaaaaaaaaaaaaaaaaaaaaaaaaaaaaaaaaaaaaggaaaaaaaaaaaaaaaaaaaaaaaaaaaagtactctgcgttgttaccactgcttaatcactagtgaattc

SEQ ID NO: 320 - protein, 389 aa, Trifolium repens
MVNVNEIRQAQRAEGPATVLAIGTATPPNCVDQSTYPDYYFRITNSEHKTELKEKFQRMCDKSMIKKRYMHLTEEILKENPSLCEYMAPSLDARQDMVVVEVPRLGKEAATKAIKEWGQPKSKITHLIFCTTSGVDMPGADYQLTKLLGLRPHVKRYMMYQQGCFAGGTVLRLAKDLAENNKGARVLVVCSEITAVTFRGPSDTHLDSLVGQALFGDGAAAVIVGSDPLPQVEKPLFELVWTAQTILPDSEGAIDGHLREVGLTFHLLKDVPGLISKNIEKALVEAFQPLGISDYNSIFWIAHPGGPAILDQVEAKLSLKPEKMQATRHVLSEYGNMSSACVLFILDEMRRKSKEDGLATTGEGLEWGVLFGFGPGLTVETVLLHSVAT

SEQ ID NO: 321 - DNA, 1653 bp, Trifolium repens
gaattcgattaagcagtggtaacaacgcagagtacgcgggactaagccttgattcattgtttgtttccataacacaagaactagtgtttgcttgaatcttaagaaaaaatgcctcaaggtgatttgaatggaagttcctcggtgaatggagcacgtgctagacgtgctcctactcagggaaaggcaacgatacttgcattaggaaaggctttccccgcccaggtcctccctcaagagtgcttggtggaaggattcattcgcgacactaagtgtgacgatacttatattaaggagaaattggagcgtctttgcaaaaacacaactgtgaaaacaagatacacagtaatgtcaaaggagatcttagacaactatccagagctagccatagatggaacaccaacaataaggcaaaagcttgaaatagcaaatccagcagtagttgaaatggcaacaagagcaagcaaagattgcatcaaagaatggggaaggtcacctcaagatatcacacacatagtctatgtttcctcgagcgaaattcgtctacccggtggtgacctttatcttgcaaatgaactcggcttaaacagcgatgttaatcgcgtaatgctctatttcctcggttgctacggcggtgtcactggcttacgtgtcgccaaagacatcgccgaaaataaccctggtagtagggtgttactcacaacatccgagaccactattctcggttttcgaccaccgagtaaagctagaccttatgacctcgttggcgctgcacttttcggtgatggcgccgctgctgcaataattggaacagaccctatattgaatcaagaatcacctttcatggaattgaaccatgcagtccaaaaattcttgcctgatacacaaaatgtgattgatggtagaatcactgaagagggtattaattttaagcttggaagagaccttcctcaaaaaattgaagacaatattgaagaattttgcaagaaaattatggctaaaagtgatgttaaggaatttaatgacttattttgggctgttcatcctggtgggccagctatactcaataagctagaaaatatactcaaattgaaaagtgataaattggattgtagtaggaaggcattaatggattatggaaatgttagtagcaatactatattctatgtgatggagtatatgagagattatttgaaggaagatggaagtgaagaatggggattaggattggcttttggaccagggattacttttgaaggggttctcctccgtagcctttaatcttgaaataataattcatatgaaattacttgtcttaagattgtgataggaagatgaatatgtattggattaatattgatatggtgttattttaagttgattttaaaaaaagtttattaataaagtatgatgtaacaattgttgtttgaatgttaaaagggaagtatactattttaagttcttgaccatactgattttttctttacacattttcatatctaaaattgttctatgatatcttcattgttgatactgtaataatataatatctaatttggctggcaaaatgaaagatttttcaccgaaaaaaaaaaaaaaaaaaaaaaaaaaaaaagtactctgcgttgttaccactgcttaatcactagtgaattc

SEQ ID NO: 322 - protein, 389 aa, Trifolium repens
MPQGDLNGSSSVNGARARRAPTQGKATILALGKAFPAQVLPQECLVEGFIRDTKCDDTYIKEKLERLCKNTTVKTRYTVMSKEILDNYPELAIDGTPTIRQKLEIANPAVVEMATRASKDCIKEWGRSPQDITHIVYVSSSEIRLPGGDLYLANELGLNSDVNRVMLYFLGCYGGVTGLRVAKDIAENNPGSRVLLTTSETTILGFRPPSKARPYDLVGAALFGDGAAAAIIGTDPILNQESPFMELNHAVQKFLPDTQNVIDGRITEEGINFKLGRDLPQKIEDNIEEFCKKIMAKSDVKEFNDLFWAVHPGGPAILNKLENILKLKSDKLDCSRKALMDYGNVSSNTIFYVMEYMRDYLKEDGSEEWGLGLAFGPGITFEGVLLRSL

SEQ ID NO: 323 - DNA, 1600 bp, Trifolium repens
gaattcactagtgattaagcagtggtaacaacgcagagtacgcgggggaatccaccaaatcaacaccattaataaccttccaaattctcgttacctcaccaaatctcatttttcattatatatcttgggtacatcttttgttacctccaacaaaaaaatggtgaccgtagaagagattcgtaacgcccaacgttcaaatggccctgccactatcttagcttttggcacagccactccttctaactgtgtcactcaagctgattatcctgattactactttcgtatcaccaacagcgaacatatgactgatcttaaggaaaaattcaagcggatgtgtgatagatcaatgataaagaaacgttacatgcacctaacagaagactttctgaaggagaatccaaatatgtgtgaatacatggcaccatcactagatgtaagacgagacatagtggttgttgaagtaccaaagctaggtaaagaagcagcaaaaaaagccatatgtgaatggggacaaccaaaatccaaaatcacacatcttgttttctgcaccacttccggtgttgacatgccgggagccgattaccaactcaccaaacttttaggcttaaaaccttctgtcaagcgtctcatgatgtatcaacaaggttgtttcgctggcggcacagttctccgcttagcaaaagaccttgttgagaataacaaaaatgcaagagttcttgttgtttgttctgaaattactgcggttacttttcgtggaccatcggatactcatcttgattcgctcgtgggacaggcgctttttggtgatggagccgcagcaatgattattggtgcggatcctgatttaaccgtggagcgtccgattttcgagattgtttcggctgctcagactattcttcctgattctgatggcgcaattgatggacatcttcgtgaagtggggctcacttttcatttattgaaagatgttccggggattatttcaaagaacattgaaaaaagtttagttgaagcttttgcgcctattgggattaatgattggaactcaatattttgggttgcacatccaggtggaccggctattttagaccaggttgaagagaaactccatcttaaagaggagaaactccggtccacccggcatgtgcttagtgaatatggaaatatgtcaagtgcatgtgttttatttattttggatgaaatgagaaagaggtctaaagaggaagggatgattacaactggtgaagggttggaatggggtgtgttgtttgggtttggaccgggtttaactgttgaaaccgttgtgcttcatagtgttccggttcagggttgaatttattatacatagattggaaaataaaatttgcctgccgagagatgtgaactaactttgtaggcaagctcaaattaaagtttgagataatattgtgctttagttattatggtatgtaatgtaatgtttttacttttttcgaaattcatgtaatttgatatgtaaagtaatatgtttgggttggaatataattatttgttaactaaaaaaaaaaaaaaaaaaaaaaaaaaaagtactctgcgttgttaccactgcttaatcgaattc

SEQ ID NO: 324 - protein, 391 aa, Trifolium repens
MVTVEEIRNAQRSNGPATILAFGTATPSNCVTQADYPDYYFRITNSEHMTDLKEKFKRMCDRSMIKKRYMHLTEDFLKENPNMCEYMAPSLDVRRDIVVVEVPKLGKEAAKKAICEWGQPKSKITHLVFCTTSGVDMPGADYQLTKLLGLKPSVKRLMMYQQGCFAGGTVLRLAKDLVENNKNARVLVVCSEITAVTFRGPSDTHLDSLVGQALFGDGAAAMIIGADPDLTVERPIFEIVSAAQTILPDSDGAIDGHLREVGLTFHLLKDVPGIISKNIEKSLVEAFAPIGINDWNSIFWVAHPGGPAILDQVEEKLHLKEEKLRSTRHVLSEYGNMSSACVLFILDEMRKRSKEEGMITTGEGLEWGVLFGFGPGLTVETVVLHSVPVQG

SEQ ID NO: 325 - DNA, 1333 bp, Trifolium repens
gaattcactagtgattaagcagtggtaacaacgcagagtacgcgggggtgacttgatctagcagttatcaaacacaacagtcttccacttgagctctgtttctccacatgtcgaagctagtttgcgtcaccggcggcagcggatgcatcggttcatggctagtccatctccttctcctccgcggctacactgttcacgccaccgtccaaaatctcaatgatgagaacgaaacgaagcatctagaagctctcgaaggagcacaaactaatctccgtctcttccagatcgatctccttaactacgacacaatcctcgctgctgtccgcggttgcgtcggaattttccacctcgcttcaccttgcactgtagacaaagttcatgatcctcagaaggagcttttggatcctgcaattaaagggactttgaatgtgcttactgcagctaaggaagtaggggtgaagcgtgtggttgttacctcgtctgtctcggcgattactcctagtcctgattggccttctgatgttgttaaaagagaggattgttggactgatgttgaatattgcaagaaaaaagagttgtggtatccgttgtccaaaacattggctgagaaagctgcgtgggatttttccaaagaaaatggtttggatgttgttgtggtgaatcccggtactgtgatgggtcctgttattccaccacggcataatgcaagcatgctcatgcttgtgagacttcttgaaggctgcgctgaaacatttgaagactattttatgggattggtccacttcaaagatgtagcattggcgcatattttggtgtatgagaacaaagaagcatctggtagacatgtgtgtgttgaaactatctctcactacggtgattttgtggcaaaagttgctgaactttatccagaatatagtgttcctaggatgcagcgagatacgcaacctggattgttgagagcgaatgatggatcaaagaagctcatagatttgggtttggaattcattccaatggagcaaattatcaaggatgctgtagagagtttgaagaacaaaggattcatttcttgaatgatgttactgttctttggagaaccctatagttaccagagtatagactaaataatatataggtgatgggtcagagaatgagtacttatgtcatgagttgtgtctgtataatatgttttctcaattcttatatgttaaattgctaatgttaacttcaatatttatcagccagtattgtttttttaataaaatattgaagcaaaaaaaaaaaaaaaaaaaaaaaaaaaagtactctgcgttgttaccactgcttaatcgaattc

SEQ ID NO: 326 - protein, 320 aa, Trifolium repens
MSKLVCVTGGSGCIGSWLVHLLLLRGYTVHATVQNLNDENETKHLEALEGAQTNLRLFQIDLLNYDTILAAVRGCVGIFHLASPCTVDKVHDPQKELLDPAIKGTLNVLTAAKEVGVKRVVVTSSVSAITPSPDWPSDVVKREDCWTDVEYCKKKELWYPLSKTLAEKAAWDFSKENGLDVVVVNPGTVMGPVIPPRHNASMLMLVRLLEGCAETFEDYFMGLVHFKDVALAHILVYENKEASGRHVCVETISHYGDFVAKVAELYPEYSVPRMQRDTQPGLLRANDGSKKLIDLGLEFIPMEQIIKDAVESLKNKGFIS

SEQ ID NO: 327 - DNA, 1470 bp, Trifolium repens
gaattcgattaagcagtggtaacaacgcagagtacgcggggaccactctatttatttctacttaaacctcacaaaaaataaaccacacaacacacaaacaccaaaaacagagcaccgtttccatcatcaaacaatggcaccagccaaaactctaagttatctctcacaacaaaacactctcgagtcaagtttcgttagggaagaagatgagcgtccaaaagttgcctacaataacttcagcaacgagattccaatcatttctcttgctggaattgatgaggttgatggtcgtagaacagagatatgtaacaagattgttgaagcttgtgagaattggggtatttttcaggttgttgatcatggtgttgatacaaaacttgtttctgagatgacccgttttgctagagagttttttgctttgccaccggaagagaagctccggtttgacatgtccggtggtaaaaagggtggtttcattgtctctagtcatcttcaaggagaagcagtgaaggattggagagagctagtgacatatttttcatacccaattaaacaaagagattattcaaggtggccagacaagccagaaggatggaaagaggtaacagaaaaatacagtgaaaacctaatgaatttagcttgcaagctattggaagttttatcagaagcaatgggtttagaaaaagaagctctaacaaaagcatgtgttgatatggatcaaaaagttgttataaattattacccaaaatgccctgaacctgacctcacacttggccttaaacgtcacactgaccctggcacaattactcttttgcttcaagatcaagttggtggtcttcaagctaccaaagataatggtaagacgtggattacagttcaaccagttgaaggtgcttttgttgttaatcttggagaccatggtcactatctaagtaatggacggttcaaaaatgctgaccatcaagcagtggtgaattcgaactacagccgtttatcaatagcaacatttcaaaatccagctccagatgcaactgtgtaccctttgaagattagagatggtgaaaaatctgtgttggaagaaccaatcacttttgctgaaatgtatagaaggaagatgaccaaagaccttgaaattgctaggatgaagaagttggctaaggaacaacaacttagggacttggaggagaacaagactaaatatgaggccaaacctttgaatgagatctttgcttaattaattagtcttaatttaaataataaattttagacttaatttacatataataattttaattttttgttcaattaatctatgtttaatttgtcgttattgtccacgtgtattaagctgcttggttgtgtgtgccttggagaataatcaataatattacatctatgtttaattataaaaaaaaaaaaaaaaaaaaaaagtatctgcgttgttaccactgcttaatcactagtgaattc

SEQ ID NO: 328 - protein, 366 aa, Trifolium repens
MAPAKTLSYLSQQNTLESSFVREEDERPKVAYNNFSNEIPIISLAGIDEVDGRRTEICNKIVEACENWGIFQVVDHGVDTKLVSEMTRFAREFFALPPEEKLRFDMSGGKKGGFIVSSHLQGEAVKDWRELVTYFSYPIKQRDYSRWPDKPEGWKEVTEKYSENLMNLACKLLEVLSEAMGLEKEALTKACVDMDQKVVINYYPKCPEPDLTLGLKRHTDPGTITLLLQDQVGGLQATKDNGKTWITVQPVEGAFVVNLGDHGHYLSNGRFKNADHQAVVNSNYSRLSIATFQNPAPDATVYPLKIRDGEKSVLEEPITFAEMYRRKMTKDLEIARMKKLAKEQQLRDLEENKTKYEAKPLNEIFA

SEQ ID NO: 329 - DNA, 2515 bp, Trifolium repens
gaattcgattaagcagtggtaacaacgcagagtacgcggggaggaaattcacaactcaaatattcctttaattctttcatataatcatttgaatttccattctccctaaaaattctatagctaccacatcacacaacataacaaattaagaaatatttattactatattaagatatggaagtagtagcagcagcaatcacaaaaaacaatggcaagattgattcattttgcttgaatcatgctaatgctaataacatgaaagtgaatggtgctgatcctttgaattggggtgtggctgctgaggcaatgaagggaagtcacttggatgaggtgaagcgtatggtggaggaataccggaaaccggttgtccgtcttggtggcgagacactaaccatttctcaggtggctgccattgctgcacacgatggtgcaacggtggagctatcggaatctgctagagccggcgttaaggcaagcagtgactgggttatggagagtatgaacaaaggtaccgacagctacggtgtcccaacagggttcggcgctacctcgcaccgccgaaccaaacaaggtggtgctttgcagaaagagctcataaggtttttgaatgctggaatatttggaaatggaactgagtcaagccacacactaccacacacagccacaagagctgccatgctagtgagaatcaacacacttctccaaggctattcaggaattagatttgaaatcttagaagctatcaccaagcttcttaacaacaatgtcaccccatgtttaccgcttcgcggtacaatcacagcttcaggagatttagtccctctttcttacattgctggtttactaaccggacgaccaaattccaaggctcatggaccttctggagaagtacttaatgcaaaacaagcttttcaatcagctggaatcgatgccgagttctttgaattacaaccaaaagaaggccttgcccttgttaacggaaccgctgttggttctggtttagcttctattgttctttttgaggctaatatattggcggtgttgtctgaagttctatctgcaattttcgctgaagttatgcaagggaagcccgaatttaccgatcatttgacacataagttgaaacatcaccctggtcaaattgaggctgctgctattatggaacacattttggatgggagtgcttatgttaaagacgctaagaagttgcatgagatggatcctttacagaagccaaaacaagatagatatgcacttaggacttcgccacaatggcttggtcctttgattgaagtgattagattctctaccaagtcaattgagagagagatcaactctgtcaatgacaatcctttgattgatgtttcaaggaacaaggctttgcatggtggaaattttcaaggaacacctatcggagtatccatggataatacacgtttggctcttgcatcaattggcaaacttatgtttgctcaattctctgagcttgtcaatgatttttacaacaatggattgccatcaaatctctctgctagtagaaatccgagcttggattatgggttcaagggatccgaaattgccatggcttcttattgttccgagttgcaatatcttgcaaatccggttacaactcatgtccaaagtgcggaacaacacaaccaagatgtcaactctttgggtttgatttcttctagaaaaacttatgaagcaattgagatccttcaattgatgtcttccacattcttgattgcactttgtcaagcaattgatttaagacatttggaggagaatttgaaaaactcggtcaaaaataccgtaagccaagtggccaaaaagacactaaccataggtgtcaatggagaacttcatccttcaagattttgtgaaaaagacttattgaaagtggttgatagggaacatgtctttgcctacattgatgatccttgtagtgctacatacccattgatgcaaaaactcaggcaagtactagtggatcatgcattagttaatggagaaagtgagaagaatttgaacacatcaatcttccaaaagattgcaacttttgaggaagagttgaaaaacctttgccaaaagaggttgaaagtgcaaggattgcatatgaaagtggaaattcaacaattccaaacaagatcaatggatgcagatcttatccactctacaattttgtgagaaaggagttgggaactggtttgctaactggagaaaatgtcatttcaccgggtgaagagtgtgacaaactattcacagctatgtgtcaaggaaaaatcattgatcctcttcttgaatgcttgggagagtggaacggtgctcctcttccaatttgttaactttgattgttagttcataaaatgttttatttgtatttatcatttgtatttatgcgagtgtagtaataatgattaggtgttttgtgcctttaatgaaaaaaaaaaaaaaaaaaaaaaaaaaaaaaagtactctgcgttgttaccactgcttaatcactagtgaattc

SEQ ID NO: 330 - protein, 671 aa, Trifolium repens
MEVVAAAITKNNGKIDSFCLNHANANNMKVNGADPLNWGVAAEAMKGSHLDEVKRMVEEYRKPVVRLGGETLTISQVAAIAAHDGATVELSESARAGVKASSDWVMESMNKGTDSYGVPTGFGATSHRRTKQGGALQKELIRFLNAGIFGNGTESSHTLPHTATRAAMLVRINTLLQGYSGIRFEILEAITKLLNNNVTPCLPLRGTITASGDLVPLSYIAGLLTGRPNSKAHGPSGEVLNAKQAFQSAGIDAEFFELQPKEGLALVNGTAVGSGLASIVLFEANILAVLSEVLSAIFAEVMQGKPEFTDHLTHKLKHHPGQIEAAAIMEHILDGSAYVKDAKKLHEMDPLQKPKQDRYALRTSPQWLGPLIEVIRFSTKSIEREINSVNDNPLIDVSRNKALHGGNFQGTPIGVSMDNTRLALASIGKLMFAQFSELVNDFYNNGLPSNLSASRNPSLDYGFKGSEIAMASYCSELQYLANPVTTHVQSAEQHNQDVNSLGLISSRKTYEAIEILQLMSSTFLIALCQAIDLRHLEENLKNSVKNTVSQVAKKTLTIGVNGELHPSRFCEKDLLKVVDREHVFAYIDDPCSATYPLMQKLRQVLVDHALVNGESEKNLNTSIFQKIATFEEELKNLCQKRLKVQGLHMKVEIQQFQTRSMDADLIHSTIL

SEQ ID NO: 331 - DNA, 2667 bp, Trifolium repens
gaattcgattaagcagtggtaacaacgcagagtacgcgggaggaaataaattcatcattgttccttatttcccacccaacacaacataacaaatacatttcctctcctctcatcacaattattactttctacacccccccctctcaactattattaactaacataatggagggaattaccaatggccatgctgaagcaactttttgcgtgaccaaaagtgttggtgatccactcaactggggtgcagccgcggagtcgttgatggggagtcatttggatgaggtgaagcgtatggtggaggaataccgtaatccattggttaaaattggcggcgagacgcttaccattgctcaggtggctggaattgcttctcatgatagtggtgtgagggtggagctgtctgagtccgccagggccggcgttaaggcgagtagtggttgggtgatggacagcatgaacaatgggactgatagttatggtgttaccactggtttcggcgccacctctcaccggagaaccaagcagggtggtgccttgcagaaggagctaattaggtttttgaatgccggaatatttggcaatggtacagaatctaactgtacactaccacacacagcaaccagagctgcaatgcttgtgagaatcaacactcttcttcaaggatattctggaattagatttgaaattttggaagctatcacaaagcttctaaacaacaacattaccccatgtttaccacttcgtggtacaatcacggcttccggtgatctcgttccgctttcctacattgccggtttgttaaccggtagaccgaactccaaagccgttggaccctccggagaaattctcaatgcaaaagaagcttttcaacttgccggcattggttctgagttttttgaattgcagccaaaagaaggtcttgctcttgttaatggtactgctgttggttctggtttagcttctattgttctgtttgaagcaaatgtactagctgttttgtctgaagttatgtcggcgattttcgctgaagttatgcaagggaaaccagaattcactgatcatttgactcataagttgaaacatcaccctggtcaaattgaagctgctgcaattatggaacatattttggatggaagtgcttatgttaaagcagctaagaaattacacgaaaccgatcctttacaaaagccgaaacaagatcgttatgcacttagaacttcacctcaatggcttggtcctttgattgaagtgataagattttcaactaagtcaattgagagagaaattaactctgtcaatgataaccctttgattgatgtttcaaggaacaaggccattcacggtggtaattttcaaggaacacctattggagtttcaatggataacacacgtttagctcttgcttcaattggtaaactcatgtttgctcaattctctgaacttgttaatgatttttacaacaacgggttaccttcgaatcttactgctagtaggaacccaagcttggattacggtttcaagggatcggaaattgccatggcttcttattgttctgagttacaatatcttgctaatcctgtcaccacccatgtccaaagtgcggagcaacacaatcaagatgttaactctttgggtttgatttcttcaagaaaaacaaatgaagctattgagatcctaaagctcatgtcttcgacatttctgattgcactttgtcaagcaattgatttaaggcatttggaggaaaatctgaggaacactgtcaagaacacggtaagccaagtagcgaagagaacactcaccaccggtgttaatggagaacttcatccttctagattttgtgagaaagatttgctcaaagttgttgatagggagtatgtatttgcctatgtcgacgatccttgtctagctacataccctttgatgcaaaagttgagacaagtgcttgtggatcatgcattggtaaatgctgatggagagaagaatttgaacacatcaatctttcaaaagattgcaacttttgaggatgaattgaaagctatcttgccaaaggaagttgaaagtacaagaactgcatatgaaaatggacaatgtggaatttcaaacaagattaaggaatgcaggtcttatccattgtacaagtttgttagagaggagttaggaaccgcgttgctaaccggagaaaaaacgatatcgctgggcgaagagtgtgacaaattgttcacagctatgtgccaaggtaaaattgttgatcctcttttggaatgccttggagagtggaatggtgctcctctaccaatatgttaattagcagaattaatatgtttctttgagaagtgatttctttatatatttgtagtatactatagtagttgcattgagaagcaattggtttgtctataagcctatggaaaatggcaaaacaattttctgctcaaagcatcgtttattaagttttccttaaagtgttaaggaacttttaattgtttttgtaatagaatttcatttgtttgccacaactttgggtgcaaatatcacgtgatacatgtggtgtttgatgtaaatggtgttttctcaattaataaatagtgtttcagccatgaaaaaaaaaaaaaaaaaaaaaaaaaaagtactctgcgttgttaccactgcttaatcactagtgaattc

SEQ ID NO: 332 - protein, 712 aa, Trifolium repens
MEGITNGHAEATFCVTKSVGDPLNWGAAAESLMGSHLDEVKRMVEEYRNPLVKIGGETLTIAQVAGIASHDSGVRVELSESARAGVKASSGWVMDSMNNGTDSYGVTTGFGATSHRRTKQGGALQKELIRFLNAGIFGNGTESNCTLPHTATRAAMLVRINTLLQGYSGIRFEILEAITKLLNNNITPCLPLRGTITASGDLVPLSYIAGLLTGRPNSKAVGPSGEILNAKEAFQLAGIGSEFFELQPKEGLALVNGTAVGSGLASIVLFEANVLAVLSEVMSAIFAEVMQGKPEFTDHLTHKLKHHPGQIEAAAIMEHILDGSAYVKAAKKLHETDPLQKPKQDRYALRTSPQWLGPLIEVIRFSTKSIEREINSVNDNPLIDVSRNKAIHGGNFQGTPIGVSMDNTRLALASIGKLMFAQFSELVNDFYNNGLPSNLTASRNPSLDYGFKGSEIAMASYCSELQYLANPVTTHVQSAEQHNQDVNSLGLISSRKTNEAIEILKLMSSTFLIALCQAIDLRHLEENLRNTVKNTVSQVAKRTLTTGVNGELHPSRFCEKDLLKVVDREYVFAYVDDPCLATYPLMQKLRQVLVDHALVNADGEKNLNTSIFQKIATFEDELKAILPKEVESTRTAYENGQCGISNKIKECRSYPLYKFVREELGTALLTGEKTISLGEECDKLFTAMCQGKIVDPLLECLGEWNGAPLPIC

SEQ ID NO: 333 - DNA, 2664 bp, Trifolium repens
gaattcactagtgattaagcagtggtaacaacgcagagtacgcggggaggaaataaattcatcattgttcattatttcccacccaacacaacataacaaatacattattctctcctctgatcacaattattactttctacaccctcctctcaactattattaactagcataatggagggaattaccaatggccatgctgaaacaactttttgcgtgaccaaaagtgttggtgatccactcaactggggtgcagccgcggagtcgttgacggggagtcatttggatgaggtgaagcgtatggtggaggagtaccgtaatccgttggctaaaattggcggcgagacgcttaccattgctcaggtggctggaattgcttctcatgatagtggtgtgagggtggagctgtccgagtccgcaagggccggcgttaaggcgagtagtgattgggtgatggatagcatgaacaatgggactgatagttacggtgttaccaccggttttggtgccacctctcaccggagaaccaagcagggtggtgctttgcagaaggagctaattaggtttttgaatgctggaatatttggcaatggtacagaatctaactgtacactaccacacacagcaactagagctgcaatgcttgtgagaatcaacactcttcttcaagggtactctggtattagatttgaaattttggaagctatcacaaagcttccaaacaacaacattaccccatgtttaccacttcgtggtacaatcacggcttccggtgatcttgttccgctttcctacattgccggtttgttaaccggaagacccaactccaaagcagttggaccttccggagaaattttgagtgctaaagaagcttttcaactcgccggcattggttctgagttttttgaattgcaaccaaaagaaggtcttgctcttgttaatggtactgctgttggctctggtttagcttctattgttctgtttgaagcaaatgtactagctgttttatccgaagttatgtcggcgattttcgctgaagttatgcaagggaaaccggaatttaccgatcatttgactcataagttgaaacatcaccctggtcaaattgaagctgctgcaattatggaacatattttggatggaagtgcttatgttaaagcagctaagaagttacacgaaaccgatcctttacaaaaaccgaaacaagatcgttatgcacttagaacttcacctcaatggcttggtcctttgattgaagtgataagattttcaaccaaatcgattgaaagagaaattaactcggtcaacgacaaccctttgatcgatgtttcaaggaacaaggccattcatggtggtaactttcaaggaacacctattggagtttcaatggataacacacgtttagctcttgcttcaattggtaaactcatgtttgctcaattctctgaacttgttaatgatttttacaacaacgggttgccttcgtatcttactgctagtaggaacccgagcttggactatggtttcaagggatcggaaattgccatggcttcgtattgttccgagttacaatatcttgctaatcctgtcaccacccatgtccaaagtgccgagcaacacaaccaagatgttaactctttgggtttgatttcttctagaaaaacaaatgaagctattgagattctcaagctcatgtcttccactttcttgattgcattatgtcaagcaatcgacttaaggcacttggaggaaaatctcaggaacaccgtcaagaacacggtaagccaagtagcgaagagaacactcaccaccggcgtcaacggagaacttcattcttctagattttgtgagaaagatttgcttaaagttgttgatagggagtatgtatttgcctatgccgacgatccttgtctagctacataccctttgatgcaaaagttgagacaagtgcttgtggatcatgcattggtaaatgttgatggagagaagaatttgaacacatcaatctttcaaaagattgcaacttttgaggatgagttgaaagctattttgccaaaggaggttgaaagtacaagaactgcatatgaaaatggacaatgtggaatttcaaacaagattaaggaatgcaggtcttatccattgtacaagtttgttagagaggagttaggaaccgcgttgctaaccggagaaaaaactatatcgccgggcgaagagtgcgataaattgttcacagctatgtgccaaggtaaaattgttgatcctcttatggaatgcctcggagagtggaatggtgctcctctaccaatatgttaattagcataatatgttttctttgagaagtgattactttatatatttgtagtatactatagtagttgcattgagaagaaattggtttgtttataagcctatggaaaatggcaaatcaattttctgctcaaagcatcgtttattaagttttccttaaagtgttaaggaacttttaattgtttttgtaatagaatttcatttgtttgccacaactttgggtgcaaatatcacatgatacatgtggtgtttgatgtaaatggtgttttttcaataaataaatagtgtttcaactaaaaaaaaaaaaaaaaaaaaaaaaaaaaaagtactctgcgttgttaccactgcttaatcgaattc

SEQ ID NO: 334 - protein, 712 aa, Trifolium repens
MEGITNGHAETTFCVTKSVGDPLNWGAAAESLTGSHLDEVKRMVEEYRNPLAKIGGETLTIAQVAGIASHDSGVRVELSESARAGVKASSDWVMDSMNNGTDSYGVTTGFGATSHRRTKQGGALQKELIRFLNAGIFGNGTESNCTLPHTATRAAMLVRINTLLQGYSGIRFEILEAITKLPNNNITPCLPLRGTITASGDLVPLSYIAGLLTGRPNSKAVGPSGEILSAKEAFQLAGIGSEFFELQPKEGLALVNGTAVGSGLASIVLFEANVLAVLSEVMSAIFAEVMQGKPEFTDHLTHKLKHHPGQIEAAAIMEHILDGSAYVKAAKKLHETDPLQKPKQDRYALRTSPQWLGPLIEVIRFSTKSIEREINSVNDNPLIDVSRNKAIHGGNFQGTPIGVSMDNTRLALASIGKLMFAQFSELVNDFYNNGLPSYLTASRNPSLDYGFKGSEIAMASYCSELQYLANPVTTHVQSAEQHNQDVNSLGLISSRKTNEAIEILKLMSSTFLIALCQAIDLRHLEENLRNTVKNTVSQVAKRTLTTGVNGELHSSRFCEKDLLKVVDREYVFAYADDPCLATYPLMQKLRQVLVDHALVNVDGEKNLNTSIFQKIATFEDELKAILPKEVESTRTAYENGQCGISNKIKECRSYPLYKFVREELGTALLTGEKTISPGEECDKLFTAMCQGKIVDPLMECLGEWNGAPLPIC

SEQ ID NO: 335 - DNA, 1296 bp, Trifolium repens
gaattcgattaagcagtggtaacaacgcagagtacgcgggatagtagtagttgagaaaaaatacacaaataaagtaaacactatcatagaaagagagtcaaaaatggctgaaggaaaaggaagggtttgtgttactggaggaacaggttttcttggttcatggatcatcaagagtcttcttgaaaatggatactctgttaataccactattagagctgatccagaacgtaagagggatgtaagcttcctaacaaatctacccggcgcatccgaaaggctacatttcttcaacgccgatctagacgacccagagagtttcaacgaagcaattgaaggttgtgtcgggatattccacaccgcttcaccaatcgatttcgccgtgagtgagccagaagaaatagtgacaaaaagaacagtggatggagcattaggaattttaaaagcatgtgtgaattcaaagacagtgaagagatttatttacacttcaagtggttctgctgtttcattcaatggaaaaaacaaagatgttttggatgagagtgattggagtgatgttgatttgcttagaagtgttaaaccatttggttggagttatggtgtttcaaagactttggctgagaaagcagtgcttgaatttggtcaacaaaatgggattgatgttgttactttgattcttccttttattgttggaagttttgtttgtcctaagcttcctgattctgttgagaaagctcttgttttggtactaggcaaaaaggaacaaattggtattataagtttccacatggtacatgtggatgatgtggctagagcacatatttatctacttgagaatcctgttccaggaggtagatataattgttcaccattctttgtatctattgaagaaatgtcacaacttctttcagccaaatatccagaatatcaaatactatcagtagatgagttgaaggaaatcaaaggtgcaaggttgccagatttgaactcgaaaaagctcgtggacgctggttttgagtttaagtatagtgtcggtgatatgttcgatgatgcgattcaatgctgcaaggaaaaaggctatctctaagtatgtgtttgaaaaaaattccatgaagctgagaaaacaataatatgcctaaaatcaatgatggctaatgaaatgtacaagtttatgcataaagttatttgtgatgaatcaaataatgaaataatcggttcatttttccgaaaaaaaaaaaaaaaaaaaaaaaaaaaaaaagtactctgcgttgttaccactgcttaatcactagtgaattc

SEQ ID NO: 336 - protein, 326 aa, Trifolium repens
MAEGKGRVCVTGGTGFLGSWIIKSLLENGYSVNTTIRADPERKRDVSFLTNLPGASERLHFFNADLDDPESFNEAIEGCVGIFHTASPIDFAVSEPEEIVTKRTVDGALGILKACVNSKTVKRFIYTSSGSAVSFNGKNKDVLDESDWSDVDLLRSVKPFGWSYGVSKTLAEKAVLEFGQQNGIDVVTLILPFIVGSFVCPKLPDSVEKALVLVLGKKEQIGIISFHMVHVDDVARAHIYLLENPVPGGRYNCSPFFVSIEEMSQLLSAKYPEYQILSVDELKEIKGARLPDLNSKKLVDAGFEFKYSVGDMFDDAIQCCKEKGYL

SEQ ID NO: 337 - DNA, 18 bp, Artificial Sequence
  Primer sequence
ttgagagcttcgtcgacc

SEQ ID NO: 338 - DNA, 18 bp, Artificial Sequence
  Primer sequence
aactcctcgtagtactcc

SEQ ID NO: 339 - DNA, 18 bp, Artificial Sequence
  Primer sequence
ttcaattggagtacttgg

SEQ ID NO: 340 - DNA, 19 bp, Artificial Sequence
  Primer sequence
actccttgttcatataacc

SEQ ID NO: 341 - DNA, 18 bp, Artificial Sequence
  Primer sequence
acatggtggtggttgagg

SEQ ID NO: 342 - DNA, 18 bp, Artificial Sequence
  Primer sequence
tgctgcactcattgttgg

SEQ ID NO: 343 - DNA, 18 bp, Artificial Sequence
  Primer sequence
acattgataaggcattgg

SEQ ID NO: 344 - DNA, 18 bp, Artificial Sequence
  Primer sequence
aggaggctgcagtcaagg

SEQ ID NO: 345 - DNA, 19 bp, Artificial Sequence
  Primer sequence
tgcctgaaattgagaaacc

SEQ ID NO: 346 - DNA, 18 bp, Artificial Sequence
  Primer sequence
aaagctagccttgaagcc

SEQ ID NO: 347 - DNA, 19 bp, Artificial Sequence
  Primer sequence
tcggacataactcatgtgg

SEQ ID NO: 348 - DNA, 18 bp, Artificial Sequence
  Primer sequence
ttgggttggagaataagg

SEQ ID NO: 349 - DNA, 18 bp, Artificial Sequence
  Primer sequence
tggacatttattggttgc

SEQ ID NO: 350 - DNA, 18 bp, Artificial Sequence
  Primer sequence
tatcatgtctggaaatgc

SEQ ID NO: 351 - DNA, 18 bp, Artificial Sequence
  Primer sequence
tttatgtgagtacatggc

SEQ ID NO: 352 - DNA, 18 bp, Artificial Sequence
  Primer sequence
agcagctgtgattgtagg

SEQ ID NO: 353 - DNA, 20 bp, Artificial Sequence
  Primer sequence
tgagaaagctcttgttgagg

SEQ ID NO: 354 - DNA, 19 bp, Artificial Sequence
  Primer sequence
agattgcatcaaagaatgg

SEQ ID NO: 355 - DNA, 17 bp, Artificial Sequence
  Primer sequence
ggtccaaaagccaatcc

SEQ ID NO: 356 - DNA, 18 bp, Artificial Sequence
  Primer sequence
taagacgagacatagtgg

SEQ ID NO: 357 - DNA, 18 bp, Artificial Sequence
  Primer sequence
tattcactaagcacatgc

SEQ ID NO: 358 - DNA, 17 bp, Artificial Sequence
  Primer sequence
ttacctcgtctgtctcg

SEQ ID NO: 359 - DNA, 18 bp, Artificial Sequence
  Primer sequence
aacacacacatgtctacc

SEQ ID NO: 360 - DNA, 18 bp, Artificial Sequence
  Primer sequence
tgaaggattggagagagc

SEQ ID NO: 361 - DNA, 17 bp, Artificial Sequence
  Primer sequence
tacacagttgcatctgg

SEQ ID NO: 362 - DNA, 18 bp, Artificial Sequence
  Primer sequence
atcggaatctgctagagc

SEQ ID NO: 363 - DNA, 18 bp, Artificial Sequence
  Primer sequence
tgttggttctggtttagc

SEQ ID NO: 364 - DNA, 18 bp, Artificial Sequence
  Primer sequence
ttcatatgcaatccttgc

SEQ ID NO: 365 - DNA, 18 bp, Artificial Sequence
  Primer sequence
tcttggttgtgttgttcc

SEQ ID NO: 366 - DNA, 18 bp, Artificial Sequence
  Primer sequence
tgggactgatagttatgg

SEQ ID NO: 367 - DNA, 18 bp, Artificial Sequence
  Primer sequence
tcttgctcttgttaatgg

SEQ ID NO: 368 - DNA, 18 bp, Artificial Sequence
  Primer sequence
agcaccattccactctcc

SEQ ID NO: 369 - DNA, 18 bp, Artificial Sequence
  Primer sequence
ttctcttcgctacttggc

SEQ ID NO: 370 - DNA, 18 bp, Artificial Sequence
  Primer sequence
atagtggtgtgagggtgg

SEQ ID NO: 371 - DNA, 18 bp, Artificial Sequence
  Primer sequence
tcttgttaatggtactgc

SEQ ID NO: 372 - DNA, 18 bp, Artificial Sequence
  Primer sequence
atttatcgcactcttcgc

SEQ ID NO: 373 - DNA, 18 bp, Artificial Sequence
  Primer sequence
aaagtggaagacatgagc

SEQ ID NO: 374 - DNA, 18 bp, Artificial Sequence
  Primer sequence
aagaacagtggatggagc

SEQ ID NO: 375 - DNA, 19 bp, Artificial Sequence
  Primer sequence
tcaactcatctactgatag

SEQ ID NO: 376 - DNA, 32 bp, Artificial Sequence
  Primer sequence
gaattctagaagcagaaagtacggacatcagc

SEQ ID NO: 377 - DNA, 29 bp, Artificial Sequence
  Primer sequence
gaattctagaaccatatggcgacacatcg

SEQ ID NO: 378 - DNA, 37 bp, Artificial Sequence
  Primer sequence
ggatcctctagagcactagtgtgtataagtttcttgg

SEQ ID NO: 379 - DNA, 35 bp, Artificial Sequence
  Primer sequence
ggatcctctagacccccttagtcttaaaatactcg

SEQ ID NO: 380 - DNA, 32 bp, Artificial Sequence
  Primer sequence
gaattctagagatctgaaacaacatagtcacc

SEQ ID NO: 381 - DNA, 30 bp, Artificial Sequence
  Primer sequence
gaattctagatcaatcttgtgctgcaatgc

SEQ ID NO: 382 - DNA, 30 bp, Artificial Sequence
  Primer sequence
gaattctagaaagttcaacgagatcaatgg

SEQ ID NO: 383 - DNA, 30 bp, Artificial Sequence
  Primer sequence
gaattctagattccgcttggtctttattgc

SEQ ID NO: 384 - DNA, 32 bp, Artificial Sequence
  Primer sequence
gaattctagaacatgggtagtgttgaaattcc

SEQ ID NO: 385 - DNA, 31 bp, Artificial Sequence
  Primer sequence
gaattctagaagatattgagtgagcttaagg

SEQ ID NO: 386 - DNA, 29 bp, Artificial Sequence
  Primer sequence
gacgtcgacattacatacatagcaggaac

SEQ ID NO: 387 - DNA, 30 bp, Artificial Sequence
  Primer sequence
gacgtcgacagtctctcattctcatatagc

SEQ ID NO: 388 - DNA, 30 bp, Artificial Sequence
  Primer sequence
gaattctagaagatatggtgagtgtagctg

SEQ ID NO: 389 - DNA, 30 bp, Artificial Sequence
  Primer sequence
gaattctagaatcacacatcttatatagcc

SEQ ID NO: 390 - DNA, 33 bp, Artificial Sequence
  Primer sequence
gaattctagaagaagaaatatgggagacgaagg

SEQ ID NO: 391 - DNA, 33 bp, Artificial Sequence
  Primer sequence
gaattctagaaagacttcatgcacacaagttcc

SEQ ID NO: 392 - DNA, 30 bp, Artificial Sequence
  Primer sequence
gaattctagaataacctatcagtactcacc

SEQ ID NO: 393 - DNA, 30 bp, Artificial Sequence
  Primer sequence
gaattctagaatctaggcaatttaagtggc

SEQ ID NO: 394 - DNA, 34 bp, Artificial Sequence
  Primer sequence
gaattctagatgattcattgtttgtttccataac

SEQ ID NO: 395 - DNA, 31 bp, Artificial Sequence
  Primer sequence
gaattctagaacatattcatcttcctatcac

SEQ ID NO: 396 - DNA, 31 bp, Artificial Sequence
  Primer sequence
gaattctagatccaaattctcgtacctcacc

SEQ ID NO: 397 - DNA, 31 bp, Artificial Sequence
  Primer sequence
gaattctagatagttcacatctctcggcagg

SEQ ID NO: 398 - DNA, 30 bp, Artificial Sequence
  Primer sequence.
gacgtcgacacaacagtcttccacttgagc

SEQ ID NO: 399 - DNA, 31 bp, Artificial Sequence
  Primer sequence
gacgtcgactctatactctggtaactatagg

SEQ ID NO: 400 - DNA, 31 bp, Artificial Sequence
  Primer sequence
gaattctagaaccacacaacacacaaacacc

SEQ ID NO: 401 - DNA, 30 bp, Artificial Sequence
  Primer sequence
gaattctagaaccaagcagcttaatacacg

SEQ ID NO: 402 - DNA, 34 bp, Artificial Sequence
  Primer sequence
agtactgcagagatatggaagtagtagcagcagc

SEQ ID NO: 403 - DNA, 32 bp, Artificial Sequence
  Primer sequence
agtactgcagtagcaaaccagttcccaactcc

SEQ ID NO: 404 - DNA, 33 bp, Artificial Sequence
  Primer sequence
agtactgcagataatggagggaattaccaatgg

SEQ ID NO: 405 - DNA, 34 bp, Artificial Sequence
  Primer sequence
agtactgcagtgctaattaacatattggtagagg

SEQ ID NO: 406 - DNA, 33 bp, Artificial Sequence; identical to SEQ ID NO: 404
  Primer sequence

SEQ ID NO: 407 - DNA, 34 bp, Artificial Sequence; identical to SEQ ID NO: 405
  Primer sequence

SEQ ID NO: 408 - DNA, 31 bp, Artificial Sequence
  Primer sequence
agtactgcagataaagagagtcaaaaatggc

SEQ ID NO: 409 - DNA, 31 bp, Artificial Sequence
  Primer sequence
agtactgcagaacacatacttagagatagcc

SEQ ID NO: 410 - DNA, 22 bp, Artificial Sequence
  Primer sequence
ttggagaggacacgctgaaatc

SEQ ID NO: 411 - DNA, 20 bp, Artificial Sequence
  Primer sequence
aggagagggttggacatcgc

SEQ ID NO: 412 - DNA, 23 bp, Artificial Sequence
  Primer sequence
catttcatttggagaggacacgc

SEQ ID NO: 413 - DNA, 22 bp, Artificial Sequence
  Primer sequence
acgaggagttctggaagatggg

SEQ ID NO: 414 - DNA, 22 bp, Artificial Sequence
  Primer sequence
ttggagaggacacgctgaaatc

SEQ ID NO: 415 - DNA, 20 bp, Artificial Sequence
  Primer sequence
gcaacaaaaccagtgccacc

SEQ ID NO: 416 - DNA, 21 bp, Artificial Sequence
  Primer sequence
tcatttggagaggacacgctg

SEQ ID NO: 417 - DNA, 19 bp, Artificial Sequence
  Primer sequence
gatgattgccccagcaagg

SEQ ID NO: 418 - DNA, 23 bp, Artificial Sequence
  Primer sequence
catttcatttggagaggacacgc

SEQ ID NO: 419 - DNA, 22 bp, Artificial Sequence
  Primer sequence
caaggttctcgacttggattgc

SEQ ID NO: 420 - DNA, 21 bp, Artificial Sequence
  Primer sequence
tcatttggagaggacacgctg

SEQ ID NO: 421 - DNA, 24 bp, Artificial Sequence
  Primer sequence
agattacctgccttgttgaacgag

SEQ ID NO: 422 - DNA, 21 bp, Artificial Sequence
  Primer sequence
tcatttggagaggacacgctg

SEQ ID NO: 423 - DNA, 25 bp, Artificial Sequence
  Primer sequence
gacggtaggagggaatagattgttc

SEQ ID NO: 424 - DNA, 21 bp, Artificial Sequence
  Primer sequence
tcatttggagaggacacgctg

SEQ ID NO: 425 - DNA, 24 bp, Artificial Sequence
  Primer sequence
ccaggttatccgagttattcaacg

SEQ ID NO: 426 - DNA, 21 bp, Artificial Sequence
  Primer sequence
ccactatccttcgcaagaccc

SEQ ID NO: 427 - DNA, 19 bp, Artificial Sequence
  Primer sequence
tcccattccaaccacaggc

SEQ ID NO: 428 - DNA, 21 bp, Artificial Sequence
  Primer sequence
tcatttggagaggacacgctg

SEQ ID NO: 429 - DNA, 24 bp, Artificial Sequence
  Primer sequence
caagccaggactcagtgacctatg

SEQ ID NO: 430 - DNA, 21 bp, Artificial Sequence
  Primer sequence
tcatttggagaggacacgctg

SEQ ID NO: 431 - DNA, 21 bp, Artificial Sequence
  Primer sequence
ctggtcaacacgatttgctgg

SEQ ID NO: 432 - DNA, 21 bp, Artificial Sequence
  Primer sequence
tcatttggagaggacacgctg

SEQ ID NO: 433 - DNA, 24 bp, Artificial Sequence
  Primer sequence
aaccacaggagaaggacttgactg

SEQ ID NO: 434 - DNA, 23 bp, Artificial Sequence
  Primer sequence
catttcatttggagaggacacgc

SEQ ID NO: 435 - DNA, 21 bp, Artificial Sequence
  Primer sequence
aacacggtttggtggatttgc

SEQ ID NO: 436 - DNA, 21 bp, Artificial Sequence
  Primer sequence
tcatttggagaggacacgctg

SEQ ID NO: 437 - DNA, 24 bp, Artificial Sequence
  Primer sequence
acaactggagaaggacttgattgg

SEQ ID NO: 438 - DNA, 22 bp, Artificial Sequence
  Primer sequence
ttggagaggacacgctgaaatc

SEQ ID NO: 439 - DNA, 21 bp, Artificial Sequence
  Primer sequence
acaagttggtgagggaatgcc

SEQ ID NO: 440 - DNA, 21 bp, Artificial Sequence
  Primer sequence
tcatttggagaggacacgctg

SEQ ID NO: 441 - DNA, 24 bp, Artificial Sequence
  Primer sequence
gggattgatacttgcttttggacc

SEQ ID NO: 442 - DNA, 21 bp, Artificial Sequence
  Primer sequence
cccactatccttcgcaagacc

SEQ ID NO: 443 - DNA, 19 bp, Artificial Sequence
  Primer sequence
agttgcagtgccgattgcc

SEQ ID NO: 444 - DNA, 23 bp, Artificial Sequence
  Primer sequence
catttcatttggagaggacacgc

SEQ ID NO: 445 - DNA, 22 bp, Artificial Sequence
  Primer sequence
aagatggacttgccacaacagg

SEQ ID NO: 446 - DNA, 23 bp, Artificial Sequence
  Primer sequence
catttcatttggagaggacacgc

SEQ ID NO: 447 - DNA, 22 bp, Artificial Sequence
  Primer sequence
tcgttgcctttccctgagtagg

SEQ ID NO: 448 - DNA, 21 bp, Artificial Sequence
  Primer sequence
tcatttggagaggacacgctg

SEQ ID NO: 449 - DNA, 20 bp, Artificial Sequence
  Primer sequence
gattggcttttggaccaggg

SEQ ID NO: 450 - DNA, 21 bp, Artificial Sequence
  Primer sequence
tcatttggagaggacacgctg

SEQ ID NO: 451 - DNA, 24 bp, Artificial Sequence
  Primer sequence
cggtcaccatttttttgttggagg

SEQ ID NO: 452 - DNA, 21 bp, Artificial Sequence
  Primer sequence
tcatttggagaggacacgctg

SEQ ID NO: 453 - DNA, 20 bp, Artificial Sequence
  Primer sequence
tgttgtttgggtttggaccg

SEQ ID NO: 454 - DNA, 23 bp, Artificial Sequence
  Primer sequence
catttcatttggagaggacacgc

SEQ ID NO: 455 - DNA, 21 bp, Artificial Sequence
  Primer sequence
attgagattttggacggtggc

SEQ ID NO: 456 - DNA, 23 bp, Artificial Sequence
  Primer sequence
catttcatttggagaggacacgc

SEQ ID NO: 457 - DNA, 22 bp, Artificial Sequence
  Primer sequence
cgcaacctggattgttgagagc

SEQ ID NO: 458 - DNA, 21 bp, Artificial Sequence
  Primer sequence
tcatttggagaggacacgctg

SEQ ID NO: 459 - DNA, 24 bp, Artificial Sequence
  Primer sequence
tcttccctaacgaaacttgactcg

SEQ ID NO: 460 - DNA, 21 bp, Artificial Sequence
  Primer sequence
tcatttggagaggacacgctg

SEQ ID NO: 461 - DNA, 25 bp, Artificial Sequence
  Primer sequence
gaacaacaacttagggacttggagg

SEQ ID NO: 462 - DNA, 22 bp, Artificial Sequence
  Primer sequence
atgacgcacaatcccactatcc

SEQ ID NO: 463 - DNA, 19 bp, Artificial Sequence
  Primer sequence
ttgcctcagcagccacacc

SEQ ID NO: 464 - DNA, 22 bp, Artificial Sequence
  Primer sequence
ggagaggacacgctgaaatcac

SEQ ID NO: 465 - DNA, 22 bp, Artificial Sequence
  Primer sequence
tgccaaaagaggttgaaagtgc

SEQ ID NO: 466 - DNA, 24 bp, Artificial Sequence
  Primer sequence
atcccactatccttcgcaagaccc

SEQ ID NO: 467 - DNA, 24 bp, Artificial Sequence
  Primer sequence
aatgactccccatcaacgactccg

SEQ ID NO: 468 - DNA, 22 bp, Artificial Sequence
  Primer sequence
ttggagaggacacgctgaaatc

SEQ ID NO: 469 - DNA, 25 bp, Artificial Sequence
  .Primer sequence
gacaaattgttcacagctatgtgcc

SEQ ID NO: 470 - DNA, 24 bp, Artificial Sequence
  Primer sequence
atcccactatccttcgcaagaccc

SEQ ID NO: 471 - DNA, 22 bp, Artificial Sequence
  Primer sequence
caccatacgcttcacctcatcc

SEQ ID NO: 472 - DNA, 21 bp, Artificial Sequence
  Primer sequence
tcatttggagaggacacgctg

SEQ ID NO: 473 - DNA, 25 bp, Artificial Sequence
  Primer sequence
ttgttagagaggagttaggaaccgc

SEQ ID NO: 474 - DNA, 21 bp, Artificial Sequence
  Primer sequence
ccactatccttcgcaagaccc

SEQ ID NO: 475 - DNA, 24 bp, Artificial Sequence
  Primer sequence
gcttacatccctcttacgttctgg

SEQ ID NO: 476 - DNA, 21 bp, Artificial Sequence
  Primer sequence
ccactatccttcgcaagaccc

SEQ ID NO: 477 - DNA, 19 bp, Artificial Sequence
  Primer sequence
aaaagctcgtggacgctgg

What is claimed is:

1. A substantially purified or isolated nucleic acid, said nucleic acid being selected from the group consisting of:
    (a) a nucleotide sequence selected from the group consisting of SEQ ID Nos: 185 and 187 to 193;
    (b) a nucleotide sequence comprising at least bases 1 to 311 of Seq ID No. 193,
    (c) a nucleotide sequence which is the full length complement to a nucleotide sequence selected from the group consisting of SEQ ID Nos: 185 and 187 to 193; and
    (d) a probe nucleotide sequence, wherein the entire probe nucleotide sequence is the same as or complementary to a portion of a target sequence, said target sequence having a sequence as defined in paragraph (a), wherein the probe nucleotide sequence has a length sufficient for sequence specific hybridization with the target sequence.

2. A construct including the nucleic acid of claim 1.

3. A plant cell, plant, plant seed or other plant part including the construct of claim 2, wherein the construct is an expression vector.

4. A method selected from the group consisting of:
    (a) modifying flavonoid biosynthesis in a plant;
    (b) modifying protein binding, metal chelation, anti-oxidation, and/or UV-light absorption in a plant;
    (c) modifying pigment production in a plant;

(d) modifying plant defense to a biotic stress; and
(e) modifying forage quality of a plant by disputing protein foam and/or conferring protection from rumen pasture bloat;
said method including introducing into said plant an effective amount of the nucleic acid of claim 1.

5. The nucleic acid of claim 1, wherein the nucleic acid sequence comprises 1-311 of Seq ID No. 193.

6. The nucleic acid of claim 1 wherein the nucleic acid is a probe having a size of at least 20 nucleotides.

7. The nucleic acid of claim 1, wherein the nucleic acid is the full length complement to a nucleotide sequence selected from the group consisting of SEQ ID Nos: 185 and 187 to 193.

8. The nucleic acid of claim 1, wherein the nucleic acid has a nucleotide sequence selected from the group consisting of SEQ ID Nos: 185 and 187 to 193.

* * * * *